United States Patent 11,655,510 (EXPERIMENTALLY VALIDATED SETS OF GENE SPECIFIC PRIMERS FOR USE IN MULTIPLEX APPLICATIONS) - sequence listing, part 3

SEQ ID NO: 50875 - DNA, 21 bp, Artificial sequence
  synthetic polynucleotide sequence
tcacatcttgccaggcaccaa

SEQ ID NO: 50876 - DNA, 21 bp, Artificial sequence
  synthetic polynucleotide sequence
caaggtctgaagtccagcgga

SEQ ID NO: 50877 - DNA, 20 bp, Artificial sequence
  synthetic polynucleotide sequence
cggaagagcttcagccacca

SEQ ID NO: 50878 - DNA, 20 bp, Artificial sequence
  synthetic polynucleotide sequence
aagtccgagcggcgggtgaa

SEQ ID NO: 50879 - DNA, 19 bp, Artificial sequence
  synthetic polynucleotide sequence
ccccatcggtaatccacca

SEQ ID NO: 50880 - DNA, 22 bp, Artificial sequence
  synthetic polynucleotide sequence
atgatgaccaccatactgacca

SEQ ID NO: 50881 - DNA, 22 bp, Artificial sequence
  synthetic polynucleotide sequence
ttcatgctggagagaagcccta

SEQ ID NO: 50882 - DNA, 22 bp, Artificial sequence
  synthetic polynucleotide sequence
gataactaagggttgagggcca

SEQ ID NO: 50883 - DNA, 20 bp, Artificial sequence
  synthetic polynucleotide sequence
acctgcagggagatcaggaa

SEQ ID NO: 50884 - DNA, 21 bp, Artificial sequence
  synthetic polynucleotide sequence
ccactgtaaaaggccaccgca

SEQ ID NO: 50885 - DNA, 21 bp, Artificial sequence
  synthetic polynucleotide sequence
caggtacagctggaccaggaa

SEQ ID NO: 50886 - DNA, 19 bp, Artificial sequence
  synthetic polynucleotide sequence
cacccagagtggctgcgca

SEQ ID NO: 50887 - DNA, 20 bp, Artificial sequence
  synthetic polynucleotide sequence
tccattggcaccaacgccca

SEQ ID NO: 50888 - DNA, 20 bp, Artificial sequence
  synthetic polynucleotide sequence
gaggcagcagcaaagtgcca

SEQ ID NO: 50889 - DNA, 21 bp, Artificial sequence
  synthetic polynucleotide sequence
ctactggcaaggctggtggaa

SEQ ID NO: 50890 - DNA, 22 bp, Artificial sequence
  synthetic polynucleotide sequence
ccattcctgacactgggaacga

SEQ ID NO: 50891 - DNA, 20 bp, Artificial sequence
  synthetic polynucleotide sequence
agccagggacactgtgtgga

SEQ ID NO: 50892 - DNA, 21 bp, Artificial sequence
  synthetic polynucleotide sequence
ctcagggcaatggtgggaaca

SEQ ID NO: 50893 - DNA, 20 bp, Artificial sequence
  synthetic polynucleotide sequence
atgcaccagagactggagca

SEQ ID NO: 50894 - DNA, 21 bp, Artificial sequence
  synthetic polynucleotide sequence
agaaactagagaggggaggca

SEQ ID NO: 50895 - DNA, 20 bp, Artificial sequence
  synthetic polynucleotide sequence
gccccgcaatctggagccaa

SEQ ID NO: 50896 - DNA, 20 bp, Artificial sequence
  synthetic polynucleotide sequence
gcagaagaggcagcggtgga

SEQ ID NO: 50897 - DNA, 22 bp, Artificial sequence
  synthetic polynucleotide sequence
tccatacgggggaaaagcccta

SEQ ID NO: 50898 - DNA, 20 bp, Artificial sequence
  synthetic polynucleotide sequence
tctggctgaaacaccggcca

SEQ ID NO: 50899 - DNA, 21 bp, Artificial sequence
  synthetic polynucleotide sequence
tgagcagtgtgagaaggggta

SEQ ID NO: 50900 - DNA, 22 bp, Artificial sequence
  synthetic polynucleotide sequence
caaaagacatgaagcccagcca

SEQ ID NO: 50901 - DNA, 22 bp, Artificial sequence
  synthetic polynucleotide sequence
atcaacgagtccacactggaga

SEQ ID NO: 50902 - DNA, 20 bp, Artificial sequence
  synthetic polynucleotide sequence
tgtctaaagctcttcccgca

SEQ ID NO: 50903 - DNA, 22 bp, Artificial sequence
  synthetic polynucleotide sequence
ttagtgctgcagaacagcagaa

SEQ ID NO: 50904 - DNA, 22 bp, Artificial sequence
  synthetic polynucleotide sequence
gaagggtaagggataggtggga

SEQ ID NO: 50905 - DNA, 20 bp, Artificial sequence
  synthetic polynucleotide sequence
cagagggtccacatgggaga

SEQ ID NO: 50906 - DNA, 23 bp, Artificial sequence
  synthetic polynucleotide sequence
gcttgaggcctgactaaagcaca

SEQ ID NO: 50907 - DNA, 21 bp, Artificial sequence
  synthetic polynucleotide sequence
ccagagagcgcacagtggaga

SEQ ID NO: 50908 - DNA, 21 bp, Artificial sequence
  synthetic polynucleotide sequence
gcccagccaaagctcttccca

SEQ ID NO: 50909 - DNA, 20 bp, Artificial sequence
  synthetic polynucleotide sequence
gctgtggccttcacggagga

SEQ ID NO: 50910 - DNA, 19 bp, Artificial sequence
  synthetic polynucleotide sequence
ttgaagggtggatgcccca

SEQ ID NO: 50911 - DNA, 21 bp, Artificial sequence
  synthetic polynucleotide sequence
gcaagggattcagtagcagca

SEQ ID NO: 50912 - DNA, 20 bp, Artificial sequence
  synthetic polynucleotide sequence
gaccctctggtgaacacgga

SEQ ID NO: 50913 - DNA, 21 bp, Artificial sequence
  synthetic polynucleotide sequence
aaggtcatcagagggtccaca

SEQ ID NO: 50914 - DNA, 21 bp, Artificial sequence
  synthetic polynucleotide sequence
aagcctttcccacacacacca

SEQ ID NO: 50915 - DNA, 22 bp, Artificial sequence
  synthetic polynucleotide sequence
caggaagtccactcagcaggaa

SEQ ID NO: 50916 - DNA, 21 bp, Artificial sequence
  synthetic polynucleotide sequence
ccccaatcctgtacacccaga

SEQ ID NO: 50917 - DNA, 21 bp, Artificial sequence
  synthetic polynucleotide sequence
gaagactgcccttgccagcaa

SEQ ID NO: 50918 - DNA, 21 bp, Artificial sequence
  synthetic polynucleotide sequence
tagtcctgcctcaacctggga

SEQ ID NO: 50919 - DNA, 22 bp, Artificial sequence
  synthetic polynucleotide sequence
ggatcattgccacaaccaccca

SEQ ID NO: 50920 - DNA, 20 bp, Artificial sequence
  synthetic polynucleotide sequence
ctttcctcctgggcagggga

SEQ ID NO: 50921 - DNA, 22 bp, Artificial sequence
  synthetic polynucleotide sequence
aatgttgagtacgggaagggca

SEQ ID NO: 50922 - DNA, 19 bp, Artificial sequence
  synthetic polynucleotide sequence
ctggttggagctccgggca

SEQ ID NO: 50923 - DNA, 22 bp, Artificial sequence
  synthetic polynucleotide sequence
atgtgaagagtgcggaaaggga

SEQ ID NO: 50924 - DNA, 22 bp, Artificial sequence
  synthetic polynucleotide sequence
gaagatgcgaggcctgactgaa

SEQ ID NO: 50925 - DNA, 20 bp, Artificial sequence
  synthetic polynucleotide sequence
gcctcacaccttcaagccca

SEQ ID NO: 50926 - DNA, 20 bp, Artificial sequence
  synthetic polynucleotide sequence
gatgggcactgagaccagca

SEQ ID NO: 50927 - DNA, 21 bp, Artificial sequence
  synthetic polynucleotide sequence
tgacctctgcgaacctgacca

SEQ ID NO: 50928 - DNA, 21 bp, Artificial sequence
  synthetic polynucleotide sequence
aatttcctgtggagaccccga

SEQ ID NO: 50929 - DNA, 21 bp, Artificial sequence
  synthetic polynucleotide sequence
tgtggcaagtgtgggaaggga

SEQ ID NO: 50930 - DNA, 20 bp, Artificial sequence
  synthetic polynucleotide sequence
cttgtgaacccgctggtgga

SEQ ID NO: 50931 - DNA, 21 bp, Artificial sequence
  synthetic polynucleotide sequence
gatcctgatggcgaagaggga

SEQ ID NO: 50932 - DNA, 21 bp, Artificial sequence
  synthetic polynucleotide sequence
acagacggcaaagttctcgga

SEQ ID NO: 50933 - DNA, 22 bp, Artificial sequence
  synthetic polynucleotide sequence
acgtgttagagagcagccagga

SEQ ID NO: 50934 - DNA, 22 bp, Artificial sequence
  synthetic polynucleotide sequence
aagaaacagggtctgtgcccaa

SEQ ID NO: 50935 - DNA, 20 bp, Artificial sequence
  synthetic polynucleotide sequence
actgacccctgctcagagga

SEQ ID NO: 50936 - DNA, 21 bp, Artificial sequence
  synthetic polynucleotide sequence
aggtcttcagggaagccccga

SEQ ID NO: 50937 - DNA, 20 bp, Artificial sequence
  synthetic polynucleotide sequence
agcggatccacaccgaggaa

SEQ ID NO: 50938 - DNA, 20 bp, Artificial sequence
  synthetic polynucleotide sequence
gtgcactgaaggcgtgccca

SEQ ID NO: 50939 - DNA, 21 bp, Artificial sequence
  synthetic polynucleotide sequence
tcacactggagagaagcccca

SEQ ID NO: 50940 - DNA, 22 bp, Artificial sequence
  synthetic polynucleotide sequence
taaaaccaaaggctctgccgca

SEQ ID NO: 50941 - DNA, 21 bp, Artificial sequence
  synthetic polynucleotide sequence
tacagacggggcatgtaggaa

SEQ ID NO: 50942 - DNA, 21 bp, Artificial sequence
  synthetic polynucleotide sequence
ttgcaagtgaagggcttccca

SEQ ID NO: 50943 - DNA, 20 bp, Artificial sequence
  synthetic polynucleotide sequence
gaaagagccttcagtgccaa

SEQ ID NO: 50944 - DNA, 19 bp, Artificial sequence
  synthetic polynucleotide sequence
cccacattcactgcagcca

SEQ ID NO: 50945 - DNA, 19 bp, Artificial sequence
  synthetic polynucleotide sequence
cgccaccaacgcacccaca

SEQ ID NO: 50946 - DNA, 21 bp, Artificial sequence
  synthetic polynucleotide sequence
gacgaggtgtgaactccgaga

SEQ ID NO: 50947 - DNA, 22 bp, Artificial sequence
  synthetic polynucleotide sequence
ataaaagggcccacactggaga

SEQ ID NO: 50948 - DNA, 18 bp, Artificial sequence
  synthetic polynucleotide sequence
gtgcctcgtgaggcccga

SEQ ID NO: 50949 - DNA, 22 bp, Artificial sequence
  synthetic polynucleotide sequence
atgggaacccacactggagaca

SEQ ID NO: 50950 - DNA, 22 bp, Artificial sequence
  synthetic polynucleotide sequence
ggaaacagtgaaggctctccca

SEQ ID NO: 50951 - DNA, 21 bp, Artificial sequence
  synthetic polynucleotide sequence
aacacctggaaccagctcaga

SEQ ID NO: 50952 - DNA, 21 bp, Artificial sequence
  synthetic polynucleotide sequence
tgatcaggtccggcttagaga

SEQ ID NO: 50953 - DNA, 21 bp, Artificial sequence
  synthetic polynucleotide sequence
tgtccctagggtaccaacaca

SEQ ID NO: 50954 - DNA, 18 bp, Artificial sequence
  synthetic polynucleotide sequence
gaacttgggcctgcacca

SEQ ID NO: 50955 - DNA, 21 bp, Artificial sequence
  synthetic polynucleotide sequence
gcctggacacttcacagcaga

SEQ ID NO: 50956 - DNA, 22 bp, Artificial sequence
  synthetic polynucleotide sequence
ttagagacagcaatacccagga

SEQ ID NO: 50957 - DNA, 21 bp, Artificial sequence
  synthetic polynucleotide sequence
aaggggagccaagtttgccga

SEQ ID NO: 50958 - DNA, 21 bp, Artificial sequence
  synthetic polynucleotide sequence
tgctgggagatggctgagcga

SEQ ID NO: 50959 - DNA, 21 bp, Artificial sequence
  synthetic polynucleotide sequence
tgcagcgccacgtgaagctca

SEQ ID NO: 50960 - DNA, 20 bp, Artificial sequence
  synthetic polynucleotide sequence
tgcaaaggcttggctcccga

SEQ ID NO: 50961 - DNA, 18 bp, Artificial sequence
  synthetic polynucleotide sequence
gatgggagctgcagcaca

SEQ ID NO: 50962 - DNA, 23 bp, Artificial sequence
  synthetic polynucleotide sequence
aaaatacaaggcacagatggaga

SEQ ID NO: 50963 - DNA, 22 bp, Artificial sequence
  synthetic polynucleotide sequence
accatgcagcacccatgacaga

SEQ ID NO: 50964 - DNA, 21 bp, Artificial sequence
  synthetic polynucleotide sequence
gtgcagttcaggcagatgcga

SEQ ID NO: 50965 - DNA, 22 bp, Artificial sequence
  synthetic polynucleotide sequence
aggaccatcataagcctggcga

SEQ ID NO: 50966 - DNA, 22 bp, Artificial sequence
  synthetic polynucleotide sequence
tagccggcacttggaacactga

SEQ ID NO: 50967 - DNA, 22 bp, Artificial sequence
  synthetic polynucleotide sequence
ggaacgacagctgggaaaacca

SEQ ID NO: 50968 - DNA, 20 bp, Artificial sequence
  synthetic polynucleotide sequence
cagtagagggctcctgggca

SEQ ID NO: 50969 - DNA, 21 bp, Artificial sequence
  synthetic polynucleotide sequence
aacagaggccactccagctca

SEQ ID NO: 50970 - DNA, 18 bp, Artificial sequence
  synthetic polynucleotide sequence
ggcgaggcagccactgga

SEQ ID NO: 50971 - DNA, 22 bp, Artificial sequence
  synthetic polynucleotide sequence
tgaagaagaggagctggaacca

SEQ ID NO: 50972 - DNA, 22 bp, Artificial sequence
  synthetic polynucleotide sequence
aatacctcgactgagtgcacca

SEQ ID NO: 50973 - DNA, 20 bp, Artificial sequence
  synthetic polynucleotide sequence
cagcggcaggagggcagaga

SEQ ID NO: 50974 - DNA, 20 bp, Artificial sequence
  synthetic polynucleotide sequence
gctgcggaggtagaggagga

SEQ ID NO: 50975 - DNA, 22 bp, Artificial sequence
  synthetic polynucleotide sequence
gaatccattaccgactccccaa

SEQ ID NO: 50976 - DNA, 22 bp, Artificial sequence
  synthetic polynucleotide sequence
actagggccagagtctaatcca

SEQ ID NO: 50977 - DNA, 23 bp, Artificial sequence
  synthetic polynucleotide sequence
caatagaggaatcccatggagca

SEQ ID NO: 50978 - DNA, 21 bp, Artificial sequence
  synthetic polynucleotide sequence
tccctgaatgtcaccaaccca

SEQ ID NO: 50979 - DNA, 21 bp, Artificial sequence
  synthetic polynucleotide sequence
tgtggtcttcaccgaggagga

SEQ ID NO: 50980 - DNA, 21 bp, Artificial sequence
  synthetic polynucleotide sequence
ggtgggaaagttgatgcccca

SEQ ID NO: 50981 - DNA, 21 bp, Artificial sequence
  synthetic polynucleotide sequence
tagacatcccagctgtgggaa

SEQ ID NO: 50982 - DNA, 21 bp, Artificial sequence
  synthetic polynucleotide sequence
tcatctgcaaaggccacccca

SEQ ID NO: 50983 - DNA, 18 bp, Artificial sequence
  synthetic polynucleotide sequence
cacggccagatcccagga

SEQ ID NO: 50984 - DNA, 20 bp, Artificial sequence
  synthetic polynucleotide sequence
ggtttggaaactggaagcca

SEQ ID NO: 50985 - DNA, 23 bp, Artificial sequence
  synthetic polynucleotide sequence
gtgccagagcatccgtcagtaga

SEQ ID NO: 50986 - DNA, 25 bp, Artificial sequence
  synthetic polynucleotide sequence
tgtgcagaaaacagcaccagatgga

SEQ ID NO: 50987 - DNA, 20 bp, Artificial sequence
  synthetic polynucleotide sequence
tggctggtcctcgaaaggca

SEQ ID NO: 50988 - DNA, 21 bp, Artificial sequence
  synthetic polynucleotide sequence
aagtcctaacctcaccaggca

SEQ ID NO: 50989 - DNA, 18 bp, Artificial sequence
  synthetic polynucleotide sequence
aacccaccgaaaggagca

SEQ ID NO: 50990 - DNA, 18 bp, Artificial sequence
  synthetic polynucleotide sequence
gggcttcaggaggcagca

SEQ ID NO: 50991 - DNA, 18 bp, Artificial sequence
  synthetic polynucleotide sequence
acgcctgcgcccagagca

SEQ ID NO: 50992 - DNA, 21 bp, Artificial sequence
  synthetic polynucleotide sequence
gctccccaagtgtctccacca

SEQ ID NO: 50993 - DNA, 22 bp, Artificial sequence
  synthetic polynucleotide sequence
ggaagacttcacactggcgaga

SEQ ID NO: 50994 - DNA, 22 bp, Artificial sequence
  synthetic polynucleotide sequence
atgtacggtaagctgatggcga

SEQ ID NO: 50995 - DNA, 21 bp, Artificial sequence
  synthetic polynucleotide sequence
accttccgggacaccagcgaa

SEQ ID NO: 50996 - DNA, 21 bp, Artificial sequence
  synthetic polynucleotide sequence
ttctggatgaaggccttccca

SEQ ID NO: 50997 - DNA, 21 bp, Artificial sequence
  synthetic polynucleotide sequence
gggcagccttcaaccagagca

SEQ ID NO: 50998 - DNA, 21 bp, Artificial sequence
  synthetic polynucleotide sequence
ttctccagtggcgactgagga

SEQ ID NO: 50999 - DNA, 20 bp, Artificial sequence
  synthetic polynucleotide sequence
acctggctgaacaccaggga

SEQ ID NO: 51000 - DNA, 21 bp, Artificial sequence
  synthetic polynucleotide sequence
ttcctccctgcacgtaaagga

SEQ ID NO: 51001 - DNA, 22 bp, Artificial sequence
  synthetic polynucleotide sequence
atgaatgtgaggagtgcgggaa

SEQ ID NO: 51002 - DNA, 20 bp, Artificial sequence
  synthetic polynucleotide sequence
tccgactgaaggcccttcca

SEQ ID NO: 51003 - DNA, 21 bp, Artificial sequence
  synthetic polynucleotide sequence
tgtgagtcacgaaaggtggca

SEQ ID NO: 51004 - DNA, 22 bp, Artificial sequence
  synthetic polynucleotide sequence
ttggggaaaccggcaaaagaga

SEQ ID NO: 51005 - DNA, 21 bp, Artificial sequence
  synthetic polynucleotide sequence
agtcaacgctgaagacgcaca

SEQ ID NO: 51006 - DNA, 20 bp, Artificial sequence
  synthetic polynucleotide sequence
tgtggatccgcctgtgcaca

SEQ ID NO: 51007 - DNA, 20 bp, Artificial sequence
  synthetic polynucleotide sequence
actcgggtaagcccagcaca

SEQ ID NO: 51008 - DNA, 20 bp, Artificial sequence
  synthetic polynucleotide sequence
tcgaagtcagcgggatcgga

SEQ ID NO: 51009 - DNA, 18 bp, Artificial sequence
  synthetic polynucleotide sequence
tggtgcaccacaagcgca

SEQ ID NO: 51010 - DNA, 18 bp, Artificial sequence
  synthetic polynucleotide sequence
ctgcagcagctccgacga

SEQ ID NO: 51011 - DNA, 22 bp, Artificial sequence
  synthetic polynucleotide sequence
ttcacagtggtgagaagcccta

SEQ ID NO: 51012 - DNA, 21 bp, Artificial sequence
  synthetic polynucleotide sequence
ttcctgcactgggtacaggca

SEQ ID NO: 51013 - DNA, 22 bp, Artificial sequence
  synthetic polynucleotide sequence
gcaacgagcaactcttgcagga

SEQ ID NO: 51014 - DNA, 22 bp, Artificial sequence
  synthetic polynucleotide sequence
gcaagacgtgaatcactccgga

SEQ ID NO: 51015 - DNA, 19 bp, Artificial sequence
  synthetic polynucleotide sequence
tcacaccagaggatccaca

SEQ ID NO: 51016 - DNA, 21 bp, Artificial sequence
  synthetic polynucleotide sequence
ggcttcgctggtggacaagca

SEQ ID NO: 51017 - DNA, 19 bp, Artificial sequence
  synthetic polynucleotide sequence
gctccaacctcagccagca

SEQ ID NO: 51018 - DNA, 18 bp, Artificial sequence
  synthetic polynucleotide sequence
caggtgcgagttgcggca

SEQ ID NO: 51019 - DNA, 20 bp, Artificial sequence
  synthetic polynucleotide sequence
tcgcacctgatccagcacga

SEQ ID NO: 51020 - DNA, 19 bp, Artificial sequence
  synthetic polynucleotide sequence
tggcgaaacccttgccaca

SEQ ID NO: 51021 - DNA, 20 bp, Artificial sequence
  synthetic polynucleotide sequence
agggcgggtctagctgggaa

SEQ ID NO: 51022 - DNA, 20 bp, Artificial sequence
  synthetic polynucleotide sequence
cccgagagcctacaggtgca

SEQ ID NO: 51023 - DNA, 19 bp, Artificial sequence
  synthetic polynucleotide sequence
tcacactaaggagacccca

SEQ ID NO: 51024 - DNA, 19 bp, Artificial sequence
  synthetic polynucleotide sequence
ctgaggacaccggctggga

SEQ ID NO: 51025 - DNA, 21 bp, Artificial sequence
  synthetic polynucleotide sequence
acaagtgtcagaggcggcaga

SEQ ID NO: 51026 - DNA, 21 bp, Artificial sequence
  synthetic polynucleotide sequence
ctcagcatcggtaagagggca

SEQ ID NO: 51027 - DNA, 22 bp, Artificial sequence
  synthetic polynucleotide sequence
atagtggggagaagccttacga

SEQ ID NO: 51028 - DNA, 21 bp, Artificial sequence
  synthetic polynucleotide sequence
actcgagtaaaggccttccca

SEQ ID NO: 51029 - DNA, 18 bp, Artificial sequence
  synthetic polynucleotide sequence
ccggccagctctccagga

SEQ ID NO: 51030 - DNA, 21 bp, Artificial sequence
  synthetic polynucleotide sequence
gcacagcagaatccctggcca

SEQ ID NO: 51031 - DNA, 21 bp, Artificial sequence
  synthetic polynucleotide sequence
acaggggagaagccttacgaa

SEQ ID NO: 51032 - DNA, 21 bp, Artificial sequence
  synthetic polynucleotide sequence
ctgatgcgcagtaagggctga

SEQ ID NO: 51033 - DNA, 21 bp, Artificial sequence
  synthetic polynucleotide sequence
tggtgccttcaagtgccccga

SEQ ID NO: 51034 - DNA, 21 bp, Artificial sequence
  synthetic polynucleotide sequence
acggttgaaacgctgcccgca

SEQ ID NO: 51035 - DNA, 20 bp, Artificial sequence
  synthetic polynucleotide sequence
tgtgcaaggagtgtgggcga

SEQ ID NO: 51036 - DNA, 20 bp, Artificial sequence
  synthetic polynucleotide sequence
gcttacactgcctgcacgca

SEQ ID NO: 51037 - DNA, 20 bp, Artificial sequence
  synthetic polynucleotide sequence
tagccataagtcagccctca

SEQ ID NO: 51038 - DNA, 21 bp, Artificial sequence
  synthetic polynucleotide sequence
taaggtgcgaagtcacacgga

SEQ ID NO: 51039 - DNA, 20 bp, Artificial sequence
  synthetic polynucleotide sequence
gagaacacacacagggcaga

SEQ ID NO: 51040 - DNA, 22 bp, Artificial sequence
  synthetic polynucleotide sequence
aggatttcccacactcaagaca

SEQ ID NO: 51041 - DNA, 19 bp, Artificial sequence
  synthetic polynucleotide sequence
ccctgcccacactgccaga

SEQ ID NO: 51042 - DNA, 21 bp, Artificial sequence
  synthetic polynucleotide sequence
ggttgaacgcagactcgcaca

SEQ ID NO: 51043 - DNA, 22 bp, Artificial sequence
  synthetic polynucleotide sequence
cagaggacgcactcaaatgaga

SEQ ID NO: 51044 - DNA, 20 bp, Artificial sequence
  synthetic polynucleotide sequence
cctcggccacactcactgca

SEQ ID NO: 51045 - DNA, 20 bp, Artificial sequence
  synthetic polynucleotide sequence
tactcctgaagacatgccca

SEQ ID NO: 51046 - DNA, 22 bp, Artificial sequence
  synthetic polynucleotide sequence
accactaccaaaggccttgcca

SEQ ID NO: 51047 - DNA, 20 bp, Artificial sequence
  synthetic polynucleotide sequence
cactacctggggaagaccca

SEQ ID NO: 51048 - DNA, 18 bp, Artificial sequence
  synthetic polynucleotide sequence
tgcatggcagaggctgca

SEQ ID NO: 51049 - DNA, 21 bp, Artificial sequence
  synthetic polynucleotide sequence
tcaggcaacccacagtggaga

SEQ ID NO: 51050 - DNA, 21 bp, Artificial sequence
  synthetic polynucleotide sequence
acgcctaaagaccttgccgca

SEQ ID NO: 51051 - DNA, 22 bp, Artificial sequence
  synthetic polynucleotide sequence
caacaagtgcactccgagaaca

SEQ ID NO: 51052 - DNA, 21 bp, Artificial sequence
  synthetic polynucleotide sequence
caggactaccgccatatccca

SEQ ID NO: 51053 - DNA, 21 bp, Artificial sequence
  synthetic polynucleotide sequence
tgctaacggggcgactacaca

SEQ ID NO: 51054 - DNA, 21 bp, Artificial sequence
  synthetic polynucleotide sequence
ctgaggctgcacatctgacca

SEQ ID NO: 51055 - DNA, 20 bp, Artificial sequence
  synthetic polynucleotide sequence
gaggccccaggtgtcactga

SEQ ID NO: 51056 - DNA, 21 bp, Artificial sequence
  synthetic polynucleotide sequence
ttctccttgctgcaacaggga

SEQ ID NO: 51057 - DNA, 21 bp, Artificial sequence
  synthetic polynucleotide sequence
tctgctcaggagcctgtgaca

SEQ ID NO: 51058 - DNA, 22 bp, Artificial sequence
  synthetic polynucleotide sequence
aatggaatccccagtgagacca

SEQ ID NO: 51059 - DNA, 19 bp, Artificial sequence
  synthetic polynucleotide sequence
ggctccagatccaccccca

SEQ ID NO: 51060 - DNA, 20 bp, Artificial sequence
  synthetic polynucleotide sequence
ggcaggacacagggttggga

SEQ ID NO: 51061 - DNA, 21 bp, Artificial sequence
  synthetic polynucleotide sequence
acacctcggagacctacctga

SEQ ID NO: 51062 - DNA, 21 bp, Artificial sequence
  synthetic polynucleotide sequence
tgagagagattcgcaccggga

SEQ ID NO: 51063 - DNA, 20 bp, Artificial sequence
  synthetic polynucleotide sequence
cagaactcctgaaaccggga

SEQ ID NO: 51064 - DNA, 18 bp, Artificial sequence
  synthetic polynucleotide sequence
gggcagtccaggacccga

SEQ ID NO: 51065 - DNA, 22 bp, Artificial sequence
  synthetic polynucleotide sequence
cacctcactccaagcagctcaa

SEQ ID NO: 51066 - DNA, 25 bp, Artificial sequence
  synthetic polynucleotide sequence
aaaacaggccctggaatacactcca

SEQ ID NO: 51067 - DNA, 21 bp, Artificial sequence
  synthetic polynucleotide sequence
ccactgtccgaagcaccccta

SEQ ID NO: 51068 - DNA, 20 bp, Artificial sequence
  synthetic polynucleotide sequence
tcccaatacctcgccagcca

SEQ ID NO: 51069 - DNA, 21 bp, Artificial sequence
  synthetic polynucleotide sequence
agaaaggcgaggagccatgga

SEQ ID NO: 51070 - DNA, 22 bp, Artificial sequence
  synthetic polynucleotide sequence
attcagccagaagctgttccca

SEQ ID NO: 51071 - DNA, 20 bp, Artificial sequence
  synthetic polynucleotide sequence
ccgtcagaagacagccctca

SEQ ID NO: 51072 - DNA, 22 bp, Artificial sequence
  synthetic polynucleotide sequence
aaaggcacttccacactgagga

SEQ ID NO: 51073 - DNA, 21 bp, Artificial sequence
  synthetic polynucleotide sequence
aacaagggaaagagccctgga

SEQ ID NO: 51074 - DNA, 23 bp, Artificial sequence
  synthetic polynucleotide sequence
caaaactggagtactcaaggcca

SEQ ID NO: 51075 - DNA, 18 bp, Artificial sequence
  synthetic polynucleotide sequence
cttcagcagcacacccga

SEQ ID NO: 51076 - DNA, 20 bp, Artificial sequence
  synthetic polynucleotide sequence
gtgggactgcagattggaga

SEQ ID NO: 51077 - DNA, 22 bp, Artificial sequence
  synthetic polynucleotide sequence
aacccactactgagccgtcaca

SEQ ID NO: 51078 - DNA, 21 bp, Artificial sequence
  synthetic polynucleotide sequence
tggagaagaggtgcggctgga

SEQ ID NO: 51079 - DNA, 21 bp, Artificial sequence
  synthetic polynucleotide sequence
tcctcagcgctgtcactccca

SEQ ID NO: 51080 - DNA, 21 bp, Artificial sequence
  synthetic polynucleotide sequence
gtacggagcaaagaggatgga

SEQ ID NO: 51081 - DNA, 21 bp, Artificial sequence
  synthetic polynucleotide sequence
caactcaccaagacgttggca

SEQ ID NO: 51082 - DNA, 18 bp, Artificial sequence
  synthetic polynucleotide sequence
ctgtaggggcagggcgga

SEQ ID NO: 51083 - DNA, 21 bp, Artificial sequence
  synthetic polynucleotide sequence
aagcccggaatggaagtggca

SEQ ID NO: 51084 - DNA, 19 bp, Artificial sequence
  synthetic polynucleotide sequence
ttccgagttgacgtgcaca

SEQ ID NO: 51085 - DNA, 20 bp, Artificial sequence
  synthetic polynucleotide sequence
agtcagcatcagcgaactca

SEQ ID NO: 51086 - DNA, 22 bp, Artificial sequence
  synthetic polynucleotide sequence
gtaagcgatgagatccaactga

SEQ ID NO: 51087 - DNA, 22 bp, Artificial sequence
  synthetic polynucleotide sequence
taaatgtgaggaatgcggggaa

SEQ ID NO: 51088 - DNA, 21 bp, Artificial sequence
  synthetic polynucleotide sequence
gaagcgtttcccacagacgga

SEQ ID NO: 51089 - DNA, 18 bp, Artificial sequence
  synthetic polynucleotide sequence
cttcagcgagccccagca

SEQ ID NO: 51090 - DNA, 18 bp, Artificial sequence
  synthetic polynucleotide sequence
gccatacaccttgcggca

SEQ ID NO: 51091 - DNA, 22 bp, Artificial sequence
  synthetic polynucleotide sequence
gaatggctcccagagttccaca

SEQ ID NO: 51092 - DNA, 19 bp, Artificial sequence
  synthetic polynucleotide sequence
tgcacactcgtcacatgca

SEQ ID NO: 51093 - DNA, 22 bp, Artificial sequence
  synthetic polynucleotide sequence
gatacctcaggatcctccggaa

SEQ ID NO: 51094 - DNA, 21 bp, Artificial sequence
  synthetic polynucleotide sequence
ggaactgctccagtaccagca

SEQ ID NO: 51095 - DNA, 20 bp, Artificial sequence
  synthetic polynucleotide sequence
tcggccctgatccgccacca

SEQ ID NO: 51096 - DNA, 20 bp, Artificial sequence
  synthetic polynucleotide sequence
cagccgccggtggttcagca

SEQ ID NO: 51097 - DNA, 18 bp, Artificial sequence
  synthetic polynucleotide sequence
caaggacggtgtcaccca

SEQ ID NO: 51098 - DNA, 18 bp, Artificial sequence
  synthetic polynucleotide sequence
gcaccatggcctggacca

SEQ ID NO: 51099 - DNA, 21 bp, Artificial sequence
  synthetic polynucleotide sequence
ccagcgagacctcaaagagca

SEQ ID NO: 51100 - DNA, 20 bp, Artificial sequence
  synthetic polynucleotide sequence
ttgcgatgcagccgcaggga

SEQ ID NO: 51101 - DNA, 22 bp, Artificial sequence
  synthetic polynucleotide sequence
atgaatgcaaggactgcgggaa

SEQ ID NO: 51102 - DNA, 21 bp, Artificial sequence
  synthetic polynucleotide sequence
ctggataaaggccttcccgca

SEQ ID NO: 51103 - DNA, 20 bp, Artificial sequence
  synthetic polynucleotide sequence
cagcccagccttggtggaga

SEQ ID NO: 51104 - DNA, 21 bp, Artificial sequence
  synthetic polynucleotide sequence
atcaggcactgaagacaggga

SEQ ID NO: 51105 - DNA, 20 bp, Artificial sequence
  synthetic polynucleotide sequence
cacacagtccctggaaggca

SEQ ID NO: 51106 - DNA, 18 bp, Artificial sequence
  synthetic polynucleotide sequence
ggtgcgtgcggaagcgca

SEQ ID NO: 51107 - DNA, 21 bp, Artificial sequence
  synthetic polynucleotide sequence
ttgtaggagagaccaacgcga

SEQ ID NO: 51108 - DNA, 20 bp, Artificial sequence
  synthetic polynucleotide sequence
tggggtggtgaaactgagga

SEQ ID NO: 51109 - DNA, 21 bp, Artificial sequence
  synthetic polynucleotide sequence
ataccctcgttgaacaccaga

SEQ ID NO: 51110 - DNA, 19 bp, Artificial sequence
  synthetic polynucleotide sequence
tcggtggagaatgaggcca

SEQ ID NO: 51111 - DNA, 22 bp, Artificial sequence
  synthetic polynucleotide sequence
aacaggagtggagcatgtggaa

SEQ ID NO: 51112 - DNA, 21 bp, Artificial sequence
  synthetic polynucleotide sequence
cgtccttcccaaactcgcgga

SEQ ID NO: 51113 - DNA, 20 bp, Artificial sequence
  synthetic polynucleotide sequence
aggtgtgaggcatgggggaa

SEQ ID NO: 51114 - DNA, 20 bp, Artificial sequence
  synthetic polynucleotide sequence
gtgagtggcctcctgcagca

SEQ ID NO: 51115 - DNA, 21 bp, Artificial sequence
  synthetic polynucleotide sequence
gcaaagcagggaggttgggaa

SEQ ID NO: 51116 - DNA, 21 bp, Artificial sequence
  synthetic polynucleotide sequence
ccagcatgaaaggcctcccta

SEQ ID NO: 51117 - DNA, 20 bp, Artificial sequence
  synthetic polynucleotide sequence
tgtcaagagcccagaggaga

SEQ ID NO: 51118 - DNA, 19 bp, Artificial sequence
  synthetic polynucleotide sequence
cagagtccaggcattccca

SEQ ID NO: 51119 - DNA, 18 bp, Artificial sequence
  synthetic polynucleotide sequence
agcacagcttcgagggca

SEQ ID NO: 51120 - DNA, 19 bp, Artificial sequence
  synthetic polynucleotide sequence
tctgagggcactgtgagca

SEQ ID NO: 51121 - DNA, 19 bp, Artificial sequence
  synthetic polynucleotide sequence
cgagtccacagcggggaga

SEQ ID NO: 51122 - DNA, 21 bp, Artificial sequence
  synthetic polynucleotide sequence
cctctccccactgtgaaggca

SEQ ID NO: 51123 - DNA, 21 bp, Artificial sequence
  synthetic polynucleotide sequence
atagatacccagcctacctca

SEQ ID NO: 51124 - DNA, 22 bp, Artificial sequence
  synthetic polynucleotide sequence
catactaaggcccgagtactga

SEQ ID NO: 51125 - DNA, 22 bp, Artificial sequence
  synthetic polynucleotide sequence
aggagaccactgacgatcctga

SEQ ID NO: 51126 - DNA, 20 bp, Artificial sequence
  synthetic polynucleotide sequence
gagcggccacagagctggca

SEQ ID NO: 51127 - DNA, 20 bp, Artificial sequence
  synthetic polynucleotide sequence
tggatgccctggggctgaca

SEQ ID NO: 51128 - DNA, 21 bp, Artificial sequence
  synthetic polynucleotide sequence
gcattgccactcctccagaga

SEQ ID NO: 51129 - DNA, 19 bp, Artificial sequence
  synthetic polynucleotide sequence
gccctggggctgagaggaa

SEQ ID NO: 51130 - DNA, 20 bp, Artificial sequence
  synthetic polynucleotide sequence
tgctgagcagggttcaggca

SEQ ID NO: 51131 - DNA, 20 bp, Artificial sequence
  synthetic polynucleotide sequence
ctggctaccctgggaagaga

SEQ ID NO: 51132 - DNA, 21 bp, Artificial sequence
  synthetic polynucleotide sequence
caccagtgaagggtgtccaca

SEQ ID NO: 51133 - DNA, 21 bp, Artificial sequence
  synthetic polynucleotide sequence
agtccacacaggcatccgcta

SEQ ID NO: 51134 - DNA, 21 bp, Artificial sequence
  synthetic polynucleotide sequence
cagtcataaggcctctcccca

SEQ ID NO: 51135 - DNA, 21 bp, Artificial sequence
  synthetic polynucleotide sequence
tcaggaagagttggtgcagca

SEQ ID NO: 51136 - DNA, 21 bp, Artificial sequence
  synthetic polynucleotide sequence
aagagaaacgtgtggaggcca

SEQ ID NO: 51137 - DNA, 22 bp, Artificial sequence
  synthetic polynucleotide sequence
atcacccctccttgagaacaca

SEQ ID NO: 51138 - DNA, 21 bp, Artificial sequence
  synthetic polynucleotide sequence
catccccactgtgcactacca

SEQ ID NO: 51139 - DNA, 21 bp, Artificial sequence
  synthetic polynucleotide sequence
acacactggagatggccctca

SEQ ID NO: 51140 - DNA, 22 bp, Artificial sequence
  synthetic polynucleotide sequence
cgaagggaactggaagtacgga

SEQ ID NO: 51141 - DNA, 21 bp, Artificial sequence
  synthetic polynucleotide sequence
gagcaccaaaaccccaggaga

SEQ ID NO: 51142 - DNA, 22 bp, Artificial sequence
  synthetic polynucleotide sequence
cctaggccaacttctccacaca

SEQ ID NO: 51143 - DNA, 20 bp, Artificial sequence
  synthetic polynucleotide sequence
gaggaacctggacgccggaa

SEQ ID NO: 51144 - DNA, 21 bp, Artificial sequence
  synthetic polynucleotide sequence
cagcaaagcccactcctcaca

SEQ ID NO: 51145 - DNA, 22 bp, Artificial sequence
  synthetic polynucleotide sequence
aactcacactggagagaagcca

SEQ ID NO: 51146 - DNA, 19 bp, Artificial sequence
  synthetic polynucleotide sequence
gcagaaggcaagtgagcca

SEQ ID NO: 51147 - DNA, 22 bp, Artificial sequence
  synthetic polynucleotide sequence
tgcacactggagatggacctca

SEQ ID NO: 51148 - DNA, 21 bp, Artificial sequence
  synthetic polynucleotide sequence
atgccttcgaagggaactgga

SEQ ID NO: 51149 - DNA, 22 bp, Artificial sequence
  synthetic polynucleotide sequence
aaacgtccctgaaaccagctca

SEQ ID NO: 51150 - DNA, 18 bp, Artificial sequence
  synthetic polynucleotide sequence
gcttctcacgggcgggca

SEQ ID NO: 51151 - DNA, 20 bp, Artificial sequence
  synthetic polynucleotide sequence
gaaaacctgagggcgggcca

SEQ ID NO: 51152 - DNA, 21 bp, Artificial sequence
  synthetic polynucleotide sequence
tgattgcggaaggccttgcca

SEQ ID NO: 51153 - DNA, 19 bp, Artificial sequence
  synthetic polynucleotide sequence
ctttccgcaccacccccga

SEQ ID NO: 51154 - DNA, 20 bp, Artificial sequence
  synthetic polynucleotide sequence
gcggccacagtcactgcaga

SEQ ID NO: 51155 - DNA, 21 bp, Artificial sequence
  synthetic polynucleotide sequence
gcagaaccccactctgggaga

SEQ ID NO: 51156 - DNA, 21 bp, Artificial sequence
  synthetic polynucleotide sequence
ccacactgaggacatcggtga

SEQ ID NO: 51157 - DNA, 22 bp, Artificial sequence
  synthetic polynucleotide sequence
ttcaggcccatcagataagcca

SEQ ID NO: 51158 - DNA, 22 bp, Artificial sequence
  synthetic polynucleotide sequence
gctacgactgaagcccttacca

SEQ ID NO: 51159 - DNA, 20 bp, Artificial sequence
  synthetic polynucleotide sequence
acagcatggacgggatgcca

SEQ ID NO: 51160 - DNA, 19 bp, Artificial sequence
  synthetic polynucleotide sequence
tagaggtggagatgtccca

SEQ ID NO: 51161 - DNA, 25 bp, Artificial sequence
  synthetic polynucleotide sequence
caccaaagaattcacactggcgaga

SEQ ID NO: 51162 - DNA, 23 bp, Artificial sequence
  synthetic polynucleotide sequence
gtaagtgaggagctcactgagaa

SEQ ID NO: 51163 - DNA, 22 bp, Artificial sequence
  synthetic polynucleotide sequence
acgaacccatccagagtgggaa

SEQ ID NO: 51164 - DNA, 19 bp, Artificial sequence
  synthetic polynucleotide sequence
tgatgtcgagtgaggagga

SEQ ID NO: 51165 - DNA, 21 bp, Artificial sequence
  synthetic polynucleotide sequence
cctgcgactccatactggaga

SEQ ID NO: 51166 - DNA, 22 bp, Artificial sequence
  synthetic polynucleotide sequence
gatagctaaaggccttcccaca

SEQ ID NO: 51167 - DNA, 20 bp, Artificial sequence
  synthetic polynucleotide sequence
cgggacaagcatggtgggaa

SEQ ID NO: 51168 - DNA, 21 bp, Artificial sequence
  synthetic polynucleotide sequence
tcgggaactgctgagtgccca

SEQ ID NO: 51169 - DNA, 20 bp, Artificial sequence
  synthetic polynucleotide sequence
aagaacctcgccacgcacca

SEQ ID NO: 51170 - DNA, 21 bp, Artificial sequence
  synthetic polynucleotide sequence
gcagtccgggcagaagaagga

SEQ ID NO: 51171 - DNA, 20 bp, Artificial sequence
  synthetic polynucleotide sequence
tcatgcaccgacccaaccca

SEQ ID NO: 51172 - DNA, 20 bp, Artificial sequence
  synthetic polynucleotide sequence
acccaccttcacaggcacga

SEQ ID NO: 51173 - DNA, 21 bp, Artificial sequence
  synthetic polynucleotide sequence
aaggcattcaggcagagggca

SEQ ID NO: 51174 - DNA, 22 bp, Artificial sequence
  synthetic polynucleotide sequence
gtaagatgggcaacctggctga

SEQ ID NO: 51175 - DNA, 22 bp, Artificial sequence
  synthetic polynucleotide sequence
aagccttcagacagcctgcaca

SEQ ID NO: 51176 - DNA, 22 bp, Artificial sequence
  synthetic polynucleotide sequence
atgtcgagcaaaagacgagcca

SEQ ID NO: 51177 - DNA, 20 bp, Artificial sequence
  synthetic polynucleotide sequence
gaaggccttccaccggcaca

SEQ ID NO: 51178 - DNA, 20 bp, Artificial sequence
  synthetic polynucleotide sequence
agatgtgagggccggctgaa

SEQ ID NO: 51179 - DNA, 18 bp, Artificial sequence
  synthetic polynucleotide sequence
ccccagcccgaccaagga

SEQ ID NO: 51180 - DNA, 21 bp, Artificial sequence
  synthetic polynucleotide sequence
tgtgcattcggaaggggctga

SEQ ID NO: 51181 - DNA, 23 bp, Artificial sequence
  synthetic polynucleotide sequence
ctcaaccctcactgaccacaaga

SEQ ID NO: 51182 - DNA, 23 bp, Artificial sequence
  synthetic polynucleotide sequence
gataagctaaaggcttggccaca

SEQ ID NO: 51183 - DNA, 19 bp, Artificial sequence
  synthetic polynucleotide sequence
ccacctggcccagtaccca

SEQ ID NO: 51184 - DNA, 20 bp, Artificial sequence
  synthetic polynucleotide sequence
cagatctgagctccggggga

SEQ ID NO: 51185 - DNA, 22 bp, Artificial sequence
  synthetic polynucleotide sequence
gaattctctcaggcggagtgga

SEQ ID NO: 51186 - DNA, 21 bp, Artificial sequence
  synthetic polynucleotide sequence
gagagattcccagggagacca

SEQ ID NO: 51187 - DNA, 21 bp, Artificial sequence
  synthetic polynucleotide sequence
ctggacccaggaaagctctga

SEQ ID NO: 51188 - DNA, 22 bp, Artificial sequence
  synthetic polynucleotide sequence
caaatcctgatctccccaggca

SEQ ID NO: 51189 - DNA, 22 bp, Artificial sequence
  synthetic polynucleotide sequence
gagtgtggaaaggccttcacca

SEQ ID NO: 51190 - DNA, 20 bp, Artificial sequence
  synthetic polynucleotide sequence
ccttctgagtccccacacca

SEQ ID NO: 51191 - DNA, 20 bp, Artificial sequence
  synthetic polynucleotide sequence
ccctggactgaggtgcgaga

SEQ ID NO: 51192 - DNA, 20 bp, Artificial sequence
  synthetic polynucleotide sequence
gttcgctctcccagaacaga

SEQ ID NO: 51193 - DNA, 21 bp, Artificial sequence
  synthetic polynucleotide sequence
tcacatgcgatcccaccacaa

SEQ ID NO: 51194 - DNA, 20 bp, Artificial sequence
  synthetic polynucleotide sequence
aggtggtggcgctcccggaa

SEQ ID NO: 51195 - DNA, 20 bp, Artificial sequence
  synthetic polynucleotide sequence
aaggccgcacaggaacagga

SEQ ID NO: 51196 - DNA, 21 bp, Artificial sequence
  synthetic polynucleotide sequence
cacagccacatcctcaaggga

SEQ ID NO: 51197 - DNA, 20 bp, Artificial sequence
  synthetic polynucleotide sequence
gaaaggactcacgctggaga

SEQ ID NO: 51198 - DNA, 20 bp, Artificial sequence
  synthetic polynucleotide sequence
cgaatgaaggctttcccaca

SEQ ID NO: 51199 - DNA, 20 bp, Artificial sequence
  synthetic polynucleotide sequence
gagcaggagaagccgcacga

SEQ ID NO: 51200 - DNA, 20 bp, Artificial sequence
  synthetic polynucleotide sequence
caggtgggagttcaggcgga

SEQ ID NO: 51201 - DNA, 20 bp, Artificial sequence
  synthetic polynucleotide sequence
cactgcacccgcatctccca

SEQ ID NO: 51202 - DNA, 21 bp, Artificial sequence
  synthetic polynucleotide sequence
gggataactgggcaaggagca

SEQ ID NO: 51203 - DNA, 21 bp, Artificial sequence
  synthetic polynucleotide sequence
gcgaccgctccaacttcagca

SEQ ID NO: 51204 - DNA, 20 bp, Artificial sequence
  synthetic polynucleotide sequence
tgtcctgcggtggatgacca

SEQ ID NO: 51205 - DNA, 22 bp, Artificial sequence
  synthetic polynucleotide sequence
ttcacagaggagagaagcccta

SEQ ID NO: 51206 - DNA, 21 bp, Artificial sequence
  synthetic polynucleotide sequence
aataagggatgggctctgaca

SEQ ID NO: 51207 - DNA, 22 bp, Artificial sequence
  synthetic polynucleotide sequence
tactggagagagaccctacaca

SEQ ID NO: 51208 - DNA, 22 bp, Artificial sequence
  synthetic polynucleotide sequence
gattgcggaaggaattcccaca

SEQ ID NO: 51209 - DNA, 20 bp, Artificial sequence
  synthetic polynucleotide sequence
tgcaactgggtgtcggccaa

SEQ ID NO: 51210 - DNA, 20 bp, Artificial sequence
  synthetic polynucleotide sequence
agagacgacgagctggggta

SEQ ID NO: 51211 - DNA, 20 bp, Artificial sequence
  synthetic polynucleotide sequence
ctggacgctgcacagcggaa

SEQ ID NO: 51212 - DNA, 20 bp, Artificial sequence
  synthetic polynucleotide sequence
ctgaccaaaggtcttgggca

SEQ ID NO: 51213 - DNA, 20 bp, Artificial sequence
  synthetic polynucleotide sequence
aggacaacgcccagtgccaa

SEQ ID NO: 51214 - DNA, 20 bp, Artificial sequence
  synthetic polynucleotide sequence
gtgtagtgacacaggcggca

SEQ ID NO: 51215 - DNA, 21 bp, Artificial sequence
  synthetic polynucleotide sequence
cactgtgggccaacttgcaga

SEQ ID NO: 51216 - DNA, 22 bp, Artificial sequence
  synthetic polynucleotide sequence
tgaaacagcagtaccccactga

SEQ ID NO: 51217 - DNA, 18 bp, Artificial sequence
  synthetic polynucleotide sequence
catcctggagtggcacga

SEQ ID NO: 51218 - DNA, 20 bp, Artificial sequence
  synthetic polynucleotide sequence
gtgcagccttctaccaagca

SEQ ID NO: 51219 - DNA, 21 bp, Artificial sequence
  synthetic polynucleotide sequence
ctccctaccttcagccaggaa

SEQ ID NO: 51220 - DNA, 21 bp, Artificial sequence
  synthetic polynucleotide sequence
acaacgaaccagtcctcagca

SEQ ID NO: 51221 - DNA, 19 bp, Artificial sequence
  synthetic polynucleotide sequence
ggtgtggagcggaccccaa

SEQ ID NO: 51222 - DNA, 20 bp, Artificial sequence
  synthetic polynucleotide sequence
cggtctcgggcacaaggtca

SEQ ID NO: 51223 - DNA, 19 bp, Artificial sequence
  synthetic polynucleotide sequence
gcgcctataccacgggcca

SEQ ID NO: 51224 - DNA, 19 bp, Artificial sequence
  synthetic polynucleotide sequence
ggctatgaggtggggccca

SEQ ID NO: 51225 - DNA, 22 bp, Artificial sequence
  synthetic polynucleotide sequence
atcagcgatgtcacactggaga

SEQ ID NO: 51226 - DNA, 20 bp, Artificial sequence
  synthetic polynucleotide sequence
tctggctgaaggctctccca

SEQ ID NO: 51227 - DNA, 20 bp, Artificial sequence
  synthetic polynucleotide sequence
agagggacactccggacgca

SEQ ID NO: 51228 - DNA, 20 bp, Artificial sequence
  synthetic polynucleotide sequence
caccactgagtgtgcccgca

SEQ ID NO: 51229 - DNA, 25 bp, Artificial sequence
  synthetic polynucleotide sequence
aaagccgactaacagggtacaggga

SEQ ID NO: 51230 - DNA, 22 bp, Artificial sequence
  synthetic polynucleotide sequence
gactacagcgtacaggcacaga

SEQ ID NO: 51231 - DNA, 22 bp, Artificial sequence
  synthetic polynucleotide sequence
tcaaatgtggcaccatggcgaa

SEQ ID NO: 51232 - DNA, 21 bp, Artificial sequence
  synthetic polynucleotide sequence
tgtgccaacatcctgggtgga

SEQ ID NO: 51233 - DNA, 22 bp, Artificial sequence
  synthetic polynucleotide sequence
atagatctcaacagcctgggga

SEQ ID NO: 51234 - DNA, 22 bp, Artificial sequence
  synthetic polynucleotide sequence
ccaaagatgacggcttcccaca

SEQ ID NO: 51235 - DNA, 21 bp, Artificial sequence
  synthetic polynucleotide sequence
gcctagaccctgcccaacaga

SEQ ID NO: 51236 - DNA, 19 bp, Artificial sequence
  synthetic polynucleotide sequence
ttcaaggccacagctccca

SEQ ID NO: 51237 - DNA, 18 bp, Artificial sequence
  synthetic polynucleotide sequence
cagtcaccagcaaccgga

SEQ ID NO: 51238 - DNA, 21 bp, Artificial sequence
  synthetic polynucleotide sequence
tggagtcgtactggacacgga

SEQ ID NO: 51239 - DNA, 18 bp, Artificial sequence
  synthetic polynucleotide sequence
gcccgtaccagtgcccca

SEQ ID NO: 51240 - DNA, 19 bp, Artificial sequence
  synthetic polynucleotide sequence
cgtcccacggcggttcaga

SEQ ID NO: 51241 - DNA, 20 bp, Artificial sequence
  synthetic polynucleotide sequence
agctgacccatacgggtgca

SEQ ID NO: 51242 - DNA, 20 bp, Artificial sequence
  synthetic polynucleotide sequence
ggcgactggccgcaagtgca

SEQ ID NO: 51243 - DNA, 22 bp, Artificial sequence
  synthetic polynucleotide sequence
ggaaaagccttcagcagacgca

SEQ ID NO: 51244 - DNA, 22 bp, Artificial sequence
  synthetic polynucleotide sequence
attcaggtgtgagcgatagcca

SEQ ID NO: 51245 - DNA, 19 bp, Artificial sequence
  synthetic polynucleotide sequence
ctggaccctgcgcagagga

SEQ ID NO: 51246 - DNA, 21 bp, Artificial sequence
  synthetic polynucleotide sequence
tcactctgcagagtccaggga

SEQ ID NO: 51247 - DNA, 20 bp, Artificial sequence
  synthetic polynucleotide sequence
gaactggtgacactcaggga

SEQ ID NO: 51248 - DNA, 22 bp, Artificial sequence
  synthetic polynucleotide sequence
aaatggaaccttcaaggccaca

SEQ ID NO: 51249 - DNA, 22 bp, Artificial sequence
  synthetic polynucleotide sequence
tcaaaccttcaccagctccaga

SEQ ID NO: 51250 - DNA, 21 bp, Artificial sequence
  synthetic polynucleotide sequence
tggctgaaaagtccctcccga

SEQ ID NO: 51251 - DNA, 20 bp, Artificial sequence
  synthetic polynucleotide sequence
aagaaacacccctgccgcca

SEQ ID NO: 51252 - DNA, 20 bp, Artificial sequence
  synthetic polynucleotide sequence
gagtctgggcagtgcgagca

SEQ ID NO: 51253 - DNA, 21 bp, Artificial sequence
  synthetic polynucleotide sequence
caaggagactctgggagagca

SEQ ID NO: 51254 - DNA, 18 bp, Artificial sequence
  synthetic polynucleotide sequence
gggatcaggatggggaca

SEQ ID NO: 51255 - DNA, 21 bp, Artificial sequence
  synthetic polynucleotide sequence
agtgcctggacactacccaga

SEQ ID NO: 51256 - DNA, 19 bp, Artificial sequence
  synthetic polynucleotide sequence
catccctcgccaccacgca

SEQ ID NO: 51257 - DNA, 20 bp, Artificial sequence
  synthetic polynucleotide sequence
ctggctggaactgacgagca

SEQ ID NO: 51258 - DNA, 21 bp, Artificial sequence
  synthetic polynucleotide sequence
tcctggcatcacgctggagca

SEQ ID NO: 51259 - DNA, 22 bp, Artificial sequence
  synthetic polynucleotide sequence
catacctcacgtggcaccaaca

SEQ ID NO: 51260 - DNA, 20 bp, Artificial sequence
  synthetic polynucleotide sequence
gaacgccttcccacactcca

SEQ ID NO: 51261 - DNA, 19 bp, Artificial sequence
  synthetic polynucleotide sequence
gagtggaccggaggagcca

SEQ ID NO: 51262 - DNA, 22 bp, Artificial sequence
  synthetic polynucleotide sequence
acctcccccaagttcaagctca

SEQ ID NO: 51263 - DNA, 22 bp, Artificial sequence
  synthetic polynucleotide sequence
ttcacactggtgagagacccta

SEQ ID NO: 51264 - DNA, 21 bp, Artificial sequence
  synthetic polynucleotide sequence
tcatagggtctctccccagca

SEQ ID NO: 51265 - DNA, 20 bp, Artificial sequence
  synthetic polynucleotide sequence
gaggagtgggggcatctcga

SEQ ID NO: 51266 - DNA, 19 bp, Artificial sequence
  synthetic polynucleotide sequence
ttggagccatgacctgtga

SEQ ID NO: 51267 - DNA, 19 bp, Artificial sequence
  synthetic polynucleotide sequence
tcagcacccaaagcagcaa

SEQ ID NO: 51268 - DNA, 18 bp, Artificial sequence
  synthetic polynucleotide sequence
gagggccctggtgctgga

SEQ ID NO: 51269 - DNA, 21 bp, Artificial sequence
  synthetic polynucleotide sequence
gaccgcattcgacaccagaga

SEQ ID NO: 51270 - DNA, 21 bp, Artificial sequence
  synthetic polynucleotide sequence
gcatgtagtcagacgagcgga

SEQ ID NO: 51271 - DNA, 20 bp, Artificial sequence
  synthetic polynucleotide sequence
gacgaaggacgcagcgcaga

SEQ ID NO: 51272 - DNA, 21 bp, Artificial sequence
  synthetic polynucleotide sequence
ggaacccgatgccctagtgaa

SEQ ID NO: 51273 - DNA, 22 bp, Artificial sequence
  synthetic polynucleotide sequence
attcgacaccgcagcattcaca

SEQ ID NO: 51274 - DNA, 20 bp, Artificial sequence
  synthetic polynucleotide sequence
tccggtgctgaatgaggcca

SEQ ID NO: 51275 - DNA, 21 bp, Artificial sequence
  synthetic polynucleotide sequence
catgtggcagatcatcaggga

SEQ ID NO: 51276 - DNA, 21 bp, Artificial sequence
  synthetic polynucleotide sequence
ttcgcaaacaacgcctcctca

SEQ ID NO: 51277 - DNA, 21 bp, Artificial sequence
  synthetic polynucleotide sequence
gaaggtgttcaaccggaggca

SEQ ID NO: 51278 - DNA, 20 bp, Artificial sequence
  synthetic polynucleotide sequence
agatggcgcgtgagggtgga

SEQ ID NO: 51279 - DNA, 20 bp, Artificial sequence
  synthetic polynucleotide sequence
gccctcagccagattccaca

SEQ ID NO: 51280 - DNA, 20 bp, Artificial sequence
  synthetic polynucleotide sequence
tcttgagggatgtgcggcga

SEQ ID NO: 51281 - DNA, 18 bp, Artificial sequence
  synthetic polynucleotide sequence
gcctcgcccctccacaga

SEQ ID NO: 51282 - DNA, 21 bp, Artificial sequence
  synthetic polynucleotide sequence
ggaagagcaaagcccgcctga

SEQ ID NO: 51283 - DNA, 22 bp, Artificial sequence
  synthetic polynucleotide sequence
atacctcagaccgcacttgaga

SEQ ID NO: 51284 - DNA, 22 bp, Artificial sequence
  synthetic polynucleotide sequence
gaaagagatgacctcgtgccga

SEQ ID NO: 51285 - DNA, 21 bp, Artificial sequence
  synthetic polynucleotide sequence
aggacacacacagggcggaga

SEQ ID NO: 51286 - DNA, 21 bp, Artificial sequence
  synthetic polynucleotide sequence
tagtgaggccaggttcctgca

SEQ ID NO: 51287 - DNA, 20 bp, Artificial sequence
  synthetic polynucleotide sequence
catgcgcataacggccgcca

SEQ ID NO: 51288 - DNA, 20 bp, Artificial sequence
  synthetic polynucleotide sequence
ggttgctgaggccaggagga

SEQ ID NO: 51289 - DNA, 21 bp, Artificial sequence
  synthetic polynucleotide sequence
agccttcacagaacgctcaga

SEQ ID NO: 51290 - DNA, 25 bp, Artificial sequence
  synthetic polynucleotide sequence
aggagacaacaaaggctttcccaca

SEQ ID NO: 51291 - DNA, 21 bp, Artificial sequence
  synthetic polynucleotide sequence
tgtggacttcaccccagagga

SEQ ID NO: 51292 - DNA, 21 bp, Artificial sequence
  synthetic polynucleotide sequence
tgttccctgaagacctctcca

SEQ ID NO: 51293 - DNA, 22 bp, Artificial sequence
  synthetic polynucleotide sequence
atgagagctcagaatggaggga

SEQ ID NO: 51294 - DNA, 21 bp, Artificial sequence
  synthetic polynucleotide sequence
agatgcacagcaaggcctgga

SEQ ID NO: 51295 - DNA, 19 bp, Artificial sequence
  synthetic polynucleotide sequence
gaccccgggacaccctgga

SEQ ID NO: 51296 - DNA, 21 bp, Artificial sequence
  synthetic polynucleotide sequence
ccagcaaagcccactcctcaa

SEQ ID NO: 51297 - DNA, 21 bp, Artificial sequence
  synthetic polynucleotide sequence
agagcagggagactggtgaga

SEQ ID NO: 51298 - DNA, 20 bp, Artificial sequence
  synthetic polynucleotide sequence
aggtgtgaggcacggctgaa

SEQ ID NO: 51299 - DNA, 20 bp, Artificial sequence
  synthetic polynucleotide sequence
ctcggctctcaggggggaca

SEQ ID NO: 51300 - DNA, 21 bp, Artificial sequence
  synthetic polynucleotide sequence
gatggtgactcaaagtgggca

SEQ ID NO: 51301 - DNA, 22 bp, Artificial sequence
  synthetic polynucleotide sequence
atcaccgaactcacacaggaga

SEQ ID NO: 51302 - DNA, 20 bp, Artificial sequence
  synthetic polynucleotide sequence
tctggcgaaaggacttccca

SEQ ID NO: 51303 - DNA, 20 bp, Artificial sequence
  synthetic polynucleotide sequence
cagccagaagcaaagcctca

SEQ ID NO: 51304 - DNA, 20 bp, Artificial sequence
  synthetic polynucleotide sequence
gagcaagggatgcaattcga

SEQ ID NO: 51305 - DNA, 21 bp, Artificial sequence
  synthetic polynucleotide sequence
tcacacctacacagtcacgga

SEQ ID NO: 51306 - DNA, 22 bp, Artificial sequence
  synthetic polynucleotide sequence
tctagtgaagcttgcgaaccca

SEQ ID NO: 51307 - DNA, 21 bp, Artificial sequence
  synthetic polynucleotide sequence
gtaggaaagcattcagccaga

SEQ ID NO: 51308 - DNA, 18 bp, Artificial sequence
  synthetic polynucleotide sequence
ttgggcaagggatccaca

SEQ ID NO: 51309 - DNA, 21 bp, Artificial sequence
  synthetic polynucleotide sequence
cggaggacccacataggggaa

SEQ ID NO: 51310 - DNA, 20 bp, Artificial sequence
  synthetic polynucleotide sequence
cccaacgtcgggagactcaa

SEQ ID NO: 51311 - DNA, 21 bp, Artificial sequence
  synthetic polynucleotide sequence
ttggaaccccaccaagtagga

SEQ ID NO: 51312 - DNA, 19 bp, Artificial sequence
  synthetic polynucleotide sequence
tcccactcctgccgagaga

SEQ ID NO: 51313 - DNA, 22 bp, Artificial sequence
  synthetic polynucleotide sequence
aatacccctacaagtgtcgcga

SEQ ID NO: 51314 - DNA, 21 bp, Artificial sequence
  synthetic polynucleotide sequence
tcgtgtgcctgcagtcgagca

SEQ ID NO: 51315 - DNA, 20 bp, Artificial sequence
  synthetic polynucleotide sequence
gagctcagaagcccgaggaa

SEQ ID NO: 51316 - DNA, 20 bp, Artificial sequence
  synthetic polynucleotide sequence
agcagagccagcgctgtcaa

SEQ ID NO: 51317 - DNA, 20 bp, Artificial sequence
  synthetic polynucleotide sequence
aaccactactgcccagccca

SEQ ID NO: 51318 - DNA, 21 bp, Artificial sequence
  synthetic polynucleotide sequence
ctgagcaaagtcctgaccgca

SEQ ID NO: 51319 - DNA, 22 bp, Artificial sequence
  synthetic polynucleotide sequence
tcatggtccatcagagaaccca

SEQ ID NO: 51320 - DNA, 20 bp, Artificial sequence
  synthetic polynucleotide sequence
tcccacacacactgcaccca

SEQ ID NO: 51321 - DNA, 21 bp, Artificial sequence
  synthetic polynucleotide sequence
gaagcgataccttgcacgcca

SEQ ID NO: 51322 - DNA, 20 bp, Artificial sequence
  synthetic polynucleotide sequence
ctacgatggcatgtcaggga

SEQ ID NO: 51323 - DNA, 20 bp, Artificial sequence
  synthetic polynucleotide sequence
cggacagttggccagaggga

SEQ ID NO: 51324 - DNA, 20 bp, Artificial sequence
  synthetic polynucleotide sequence
ccagtgtgtgaaacggggga

SEQ ID NO: 51325 - DNA, 20 bp, Artificial sequence
  synthetic polynucleotide sequence
cgtgtcgcactcggacctca

SEQ ID NO: 51326 - DNA, 18 bp, Artificial sequence
  synthetic polynucleotide sequence
ctccgcggcgtcctggaa

SEQ ID NO: 51327 - DNA, 21 bp, Artificial sequence
  synthetic polynucleotide sequence
agcatcacccactcggaggta

SEQ ID NO: 51328 - DNA, 18 bp, Artificial sequence
  synthetic polynucleotide sequence
gcatcccggaagcggcga

SEQ ID NO: 51329 - DNA, 19 bp, Artificial sequence
  synthetic polynucleotide sequence
tggcacctgctcagaggga

SEQ ID NO: 51330 - DNA, 22 bp, Artificial sequence
  synthetic polynucleotide sequence
caatactggacacaggcctcca

SEQ ID NO: 51331 - DNA, 23 bp, Artificial sequence
  synthetic polynucleotide sequence
ggagctgaaggagtaggacagaa

SEQ ID NO: 51332 - DNA, 25 bp, Artificial sequence
  synthetic polynucleotide sequence
cagccacatccccaaatgtcaccaa

SEQ ID NO: 51333 - DNA, 22 bp, Artificial sequence
  synthetic polynucleotide sequence
aaaggccttacgagtgcagcaa

SEQ ID NO: 51334 - DNA, 21 bp, Artificial sequence
  synthetic polynucleotide sequence
gatagaggcctgaacgggtca

SEQ ID NO: 51335 - DNA, 22 bp, Artificial sequence
  synthetic polynucleotide sequence
atgaatgcagccagtgtgggaa

SEQ ID NO: 51336 - DNA, 20 bp, Artificial sequence
  synthetic polynucleotide sequence
tggatgaaggcctgtccgca

SEQ ID NO: 51337 - DNA, 21 bp, Artificial sequence
  synthetic polynucleotide sequence
cagctccaagtgcatcagcga

SEQ ID NO: 51338 - DNA, 22 bp, Artificial sequence
  synthetic polynucleotide sequence
tgaacgaagcctttcccacaga

SEQ ID NO: 51339 - DNA, 21 bp, Artificial sequence
  synthetic polynucleotide sequence
tcctgcctcactgaacccaga

SEQ ID NO: 51340 - DNA, 21 bp, Artificial sequence
  synthetic polynucleotide sequence
tgtctgacgctgcaagagtga

SEQ ID NO: 51341 - DNA, 22 bp, Artificial sequence
  synthetic polynucleotide sequence
accagagacttcacactgggga

SEQ ID NO: 51342 - DNA, 20 bp, Artificial sequence
  synthetic polynucleotide sequence
tcccacatacctcacacgca

SEQ ID NO: 51343 - DNA, 22 bp, Artificial sequence
  synthetic polynucleotide sequence
tagcctgttccagagaccacca

SEQ ID NO: 51344 - DNA, 21 bp, Artificial sequence
  synthetic polynucleotide sequence
tccccaaacgtgactgctcca

SEQ ID NO: 51345 - DNA, 21 bp, Artificial sequence
  synthetic polynucleotide sequence
gaagccggagttgatgcaaca

SEQ ID NO: 51346 - DNA, 20 bp, Artificial sequence
  synthetic polynucleotide sequence
gagccagggcggcttgagga

SEQ ID NO: 51347 - DNA, 21 bp, Artificial sequence
  synthetic polynucleotide sequence
gtcgagccctacagtcaggaa

SEQ ID NO: 51348 - DNA, 22 bp, Artificial sequence
  synthetic polynucleotide sequence
ggtatccatctcagggacctca

SEQ ID NO: 51349 - DNA, 21 bp, Artificial sequence
  synthetic polynucleotide sequence
agagcctgcatactggagaga

SEQ ID NO: 51350 - DNA, 20 bp, Artificial sequence
  synthetic polynucleotide sequence
agctgccctggaaagcccta

SEQ ID NO: 51351 - DNA, 21 bp, Artificial sequence
  synthetic polynucleotide sequence
tcatatggtccgcaagcctga

SEQ ID NO: 51352 - DNA, 21 bp, Artificial sequence
  synthetic polynucleotide sequence
tcattcagggctgtggaccga

SEQ ID NO: 51353 - DNA, 23 bp, Artificial sequence
  synthetic polynucleotide sequence
gctagtacaatgccatcaccgga

SEQ ID NO: 51354 - DNA, 20 bp, Artificial sequence
  synthetic polynucleotide sequence
gatgtgtccagcagggccca

SEQ ID NO: 51355 - DNA, 21 bp, Artificial sequence
  synthetic polynucleotide sequence
ttctccctgggaaggagccaa

SEQ ID NO: 51356 - DNA, 22 bp, Artificial sequence
  synthetic polynucleotide sequence
ggatagatgagagtgctggcga

SEQ ID NO: 51357 - DNA, 18 bp, Artificial sequence
  synthetic polynucleotide sequence
gggacctgctgggggaga

SEQ ID NO: 51358 - DNA, 21 bp, Artificial sequence
  synthetic polynucleotide sequence
agtccgtgtgtgcagacagga

SEQ ID NO: 51359 - DNA, 21 bp, Artificial sequence
  synthetic polynucleotide sequence
aaggaccaggaaaagacccca

SEQ ID NO: 51360 - DNA, 21 bp, Artificial sequence
  synthetic polynucleotide sequence
tcatagggcttcactccagca

SEQ ID NO: 51361 - DNA, 22 bp, Artificial sequence
  synthetic polynucleotide sequence
acatgatcacaggcatgctgga

SEQ ID NO: 51362 - DNA, 22 bp, Artificial sequence
  synthetic polynucleotide sequence
ggatgttgaaaccgagggagca

SEQ ID NO: 51363 - DNA, 22 bp, Artificial sequence
  synthetic polynucleotide sequence
agcaacgaagagccatggctca

SEQ ID NO: 51364 - DNA, 20 bp, Artificial sequence
  synthetic polynucleotide sequence
tctgacattcgctgcaccca

SEQ ID NO: 51365 - DNA, 22 bp, Artificial sequence
  synthetic polynucleotide sequence
gcattgatcccagcacagagca

SEQ ID NO: 51366 - DNA, 21 bp, Artificial sequence
  synthetic polynucleotide sequence
ttctggctaaactctgcccca

SEQ ID NO: 51367 - DNA, 21 bp, Artificial sequence
  synthetic polynucleotide sequence
actggaaggactctcggggaa

SEQ ID NO: 51368 - DNA, 20 bp, Artificial sequence
  synthetic polynucleotide sequence
ctggagagagatatgcccca

SEQ ID NO: 51369 - DNA, 20 bp, Artificial sequence
  synthetic polynucleotide sequence
cccctaaaactcccccgaca

SEQ ID NO: 51370 - DNA, 20 bp, Artificial sequence
  synthetic polynucleotide sequence
ctgatggggtagccacagga

SEQ ID NO: 51371 - DNA, 21 bp, Artificial sequence
  synthetic polynucleotide sequence
cagagaagtcacacggcggaa

SEQ ID NO: 51372 - DNA, 20 bp, Artificial sequence
  synthetic polynucleotide sequence
aaggcccggacgcttgtgaa

SEQ ID NO: 51373 - DNA, 22 bp, Artificial sequence
  synthetic polynucleotide sequence
tgcagcaagaccttcagtcgca

SEQ ID NO: 51374 - DNA, 20 bp, Artificial sequence
  synthetic polynucleotide sequence
tacgcacgaaagccttgtca

SEQ ID NO: 51375 - DNA, 21 bp, Artificial sequence
  synthetic polynucleotide sequence
acaggggagagaccgtatgga

SEQ ID NO: 51376 - DNA, 21 bp, Artificial sequence
  synthetic polynucleotide sequence
aatgaggtctgagctgccaca

SEQ ID NO: 51377 - DNA, 22 bp, Artificial sequence
  synthetic polynucleotide sequence
aggaatcactgaccctggagga

SEQ ID NO: 51378 - DNA, 21 bp, Artificial sequence
  synthetic polynucleotide sequence
ctccaccatcacatcccggta

SEQ ID NO: 51379 - DNA, 21 bp, Artificial sequence
  synthetic polynucleotide sequence
atgcaggcccaggaatcccta

SEQ ID NO: 51380 - DNA, 19 bp, Artificial sequence
  synthetic polynucleotide sequence
tgataccccactgccacca

SEQ ID NO: 51381 - DNA, 22 bp, Artificial sequence
  synthetic polynucleotide sequence
ataaagaagtgccagtgcccca

SEQ ID NO: 51382 - DNA, 21 bp, Artificial sequence
  synthetic polynucleotide sequence
ctgcagttcagccagacgtga

SEQ ID NO: 51383 - DNA, 20 bp, Artificial sequence
  synthetic polynucleotide sequence
gatcctggacccgcagcaga

SEQ ID NO: 51384 - DNA, 19 bp, Artificial sequence
  synthetic polynucleotide sequence
ggggttctcgacggcagca

SEQ ID NO: 51385 - DNA, 21 bp, Artificial sequence
  synthetic polynucleotide sequence
catccagcatcagaagtggca

SEQ ID NO: 51386 - DNA, 21 bp, Artificial sequence
  synthetic polynucleotide sequence
aagaaaggcacagagggagga

SEQ ID NO: 51387 - DNA, 21 bp, Artificial sequence
  synthetic polynucleotide sequence
gaatgaatgggccagcctgga

SEQ ID NO: 51388 - DNA, 21 bp, Artificial sequence
  synthetic polynucleotide sequence
gaccagaacaggcgtggtgaa

SEQ ID NO: 51389 - DNA, 19 bp, Artificial sequence
  synthetic polynucleotide sequence
tggcctcaggagtcagtga

SEQ ID NO: 51390 - DNA, 22 bp, Artificial sequence
  synthetic polynucleotide sequence
ggaaacgctaccagagaagcca

SEQ ID NO: 51391 - DNA, 20 bp, Artificial sequence
  synthetic polynucleotide sequence
gtggtgcaacgagaaaggga

SEQ ID NO: 51392 - DNA, 20 bp, Artificial sequence
  synthetic polynucleotide sequence
agcgatgacccactctggca

SEQ ID NO: 51393 - DNA, 22 bp, Artificial sequence
  synthetic polynucleotide sequence
agctcatagagggggaagccaa

SEQ ID NO: 51394 - DNA, 20 bp, Artificial sequence
  synthetic polynucleotide sequence
ctcctgaatgaacgcgctga

SEQ ID NO: 51395 - DNA, 21 bp, Artificial sequence
  synthetic polynucleotide sequence
agccctgaagttacccagcca

SEQ ID NO: 51396 - DNA, 19 bp, Artificial sequence
  synthetic polynucleotide sequence
ttggaaactgcaagcccca

SEQ ID NO: 51397 - DNA, 22 bp, Artificial sequence
  synthetic polynucleotide sequence
agctgacactggacacaagcca

SEQ ID NO: 51398 - DNA, 18 bp, Artificial sequence
  synthetic polynucleotide sequence
ccccccagtgtgagccca

SEQ ID NO: 51399 - DNA, 18 bp, Artificial sequence
  synthetic polynucleotide sequence
ggacactgcacagcggaa

SEQ ID NO: 51400 - DNA, 21 bp, Artificial sequence
  synthetic polynucleotide sequence
gaaaagcagccacactgtgca

SEQ ID NO: 51401 - DNA, 22 bp, Artificial sequence
  synthetic polynucleotide sequence
tgatgcgggaaaccttcaggaa

SEQ ID NO: 51402 - DNA, 21 bp, Artificial sequence
  synthetic polynucleotide sequence
agtgatgaaggacccatgcca

SEQ ID NO: 51403 - DNA, 21 bp, Artificial sequence
  synthetic polynucleotide sequence
gcagcaacactggaggaggca

SEQ ID NO: 51404 - DNA, 21 bp, Artificial sequence
  synthetic polynucleotide sequence
actgcgggtagagtctggaca

SEQ ID NO: 51405 - DNA, 21 bp, Artificial sequence
  synthetic polynucleotide sequence
atcaggaaggtgagggcgaga

SEQ ID NO: 51406 - DNA, 21 bp, Artificial sequence
  synthetic polynucleotide sequence
acttctgtgaagccggctcca

SEQ ID NO: 51407 - DNA, 21 bp, Artificial sequence
  synthetic polynucleotide sequence
gaagtcacacctcactggcca

SEQ ID NO: 51408 - DNA, 21 bp, Artificial sequence
  synthetic polynucleotide sequence
ttcagggaaaaggccctccca

SEQ ID NO: 51409 - DNA, 18 bp, Artificial sequence
  synthetic polynucleotide sequence
gcaagagcggatcccaca

SEQ ID NO: 51410 - DNA, 20 bp, Artificial sequence
  synthetic polynucleotide sequence
caaagggagaccgaatggga

SEQ ID NO: 51411 - DNA, 22 bp, Artificial sequence
  synthetic polynucleotide sequence
atgtgtgtcgagtatgcaagga

SEQ ID NO: 51412 - DNA, 22 bp, Artificial sequence
  synthetic polynucleotide sequence
ggtagagttcactgcttgagga

SEQ ID NO: 51413 - DNA, 19 bp, Artificial sequence
  synthetic polynucleotide sequence
cgtgccccaccagtgccaa

SEQ ID NO: 51414 - DNA, 21 bp, Artificial sequence
  synthetic polynucleotide sequence
gctcttctcacagcgagggca

SEQ ID NO: 51415 - DNA, 22 bp, Artificial sequence
  synthetic polynucleotide sequence
aaaacgccttaagtggaggcca

SEQ ID NO: 51416 - DNA, 21 bp, Artificial sequence
  synthetic polynucleotide sequence
ggctgatccacaggctgtcca

SEQ ID NO: 51417 - DNA, 21 bp, Artificial sequence
  synthetic polynucleotide sequence
tcctccactacgtgctcccca

SEQ ID NO: 51418 - DNA, 22 bp, Artificial sequence
  synthetic polynucleotide sequence
atgtagggttgaaggaggtgga

SEQ ID NO: 51419 - DNA, 20 bp, Artificial sequence
  synthetic polynucleotide sequence
actcagagaatcggcggcga

SEQ ID NO: 51420 - DNA, 20 bp, Artificial sequence
  synthetic polynucleotide sequence
tcccgcaggtgccgctccaa

SEQ ID NO: 51421 - DNA, 21 bp, Artificial sequence
  synthetic polynucleotide sequence
ggtgcacataggcaaacggca

SEQ ID NO: 51422 - DNA, 25 bp, Artificial sequence
  synthetic polynucleotide sequence
taaaggtactcccccaaaaagggca

SEQ ID NO: 51423 - DNA, 22 bp, Artificial sequence
  synthetic polynucleotide sequence
tacaggctcactgaacacgaga

SEQ ID NO: 51424 - DNA, 20 bp, Artificial sequence
  synthetic polynucleotide sequence
ctggggaaggctttcccaca

SEQ ID NO: 51425 - DNA, 20 bp, Artificial sequence
  synthetic polynucleotide sequence
caacttccccagccacccca

SEQ ID NO: 51426 - DNA, 20 bp, Artificial sequence
  synthetic polynucleotide sequence
gtgtgagaaggggtggggga

SEQ ID NO: 51427 - DNA, 20 bp, Artificial sequence
  synthetic polynucleotide sequence
gagaagaggcggcggagcaa

SEQ ID NO: 51428 - DNA, 20 bp, Artificial sequence
  synthetic polynucleotide sequence
gctgctgagggccacgtaga

SEQ ID NO: 51429 - DNA, 23 bp, Artificial sequence
  synthetic polynucleotide sequence
caaattgctgcagctcaacagga

SEQ ID NO: 51430 - DNA, 19 bp, Artificial sequence
  synthetic polynucleotide sequence
tcagccacatgctcaggga

SEQ ID NO: 51431 - DNA, 21 bp, Artificial sequence
  synthetic polynucleotide sequence
gccctgagtcatacccaggca

SEQ ID NO: 51432 - DNA, 22 bp, Artificial sequence
  synthetic polynucleotide sequence
aaaaggagtttccgagcaggga

SEQ ID NO: 51433 - DNA, 20 bp, Artificial sequence
  synthetic polynucleotide sequence
tagaactcgctcaggggaga

SEQ ID NO: 51434 - DNA, 21 bp, Artificial sequence
  synthetic polynucleotide sequence
atgggcaaatggcttcccaca

SEQ ID NO: 51435 - DNA, 22 bp, Artificial sequence
  synthetic polynucleotide sequence
tccacactggactgaagcccta

SEQ ID NO: 51436 - DNA, 22 bp, Artificial sequence
  synthetic polynucleotide sequence
tgatataaggcccgaactccga

SEQ ID NO: 51437 - DNA, 21 bp, Artificial sequence
  synthetic polynucleotide sequence
ttgaggaagcacaggacctca

SEQ ID NO: 51438 - DNA, 21 bp, Artificial sequence
  synthetic polynucleotide sequence
cgtcccccattgaggtaacca

SEQ ID NO: 51439 - DNA, 22 bp, Artificial sequence
  synthetic polynucleotide sequence
tgcatccaccagagagtccaca

SEQ ID NO: 51440 - DNA, 21 bp, Artificial sequence
  synthetic polynucleotide sequence
tggtggatgcagaggctcgta

SEQ ID NO: 51441 - DNA, 21 bp, Artificial sequence
  synthetic polynucleotide sequence
gcacttggaaagggcagagga

SEQ ID NO: 51442 - DNA, 20 bp, Artificial sequence
  synthetic polynucleotide sequence
tgtgcccggccagtagagaa

SEQ ID NO: 51443 - DNA, 21 bp, Artificial sequence
  synthetic polynucleotide sequence
ttctgcacgggggaaatccaa

SEQ ID NO: 51444 - DNA, 21 bp, Artificial sequence
  synthetic polynucleotide sequence
aagcgagaccaggttccggta

SEQ ID NO: 51445 - DNA, 20 bp, Artificial sequence
  synthetic polynucleotide sequence
gtgccgagagtgcaaggaga

SEQ ID NO: 51446 - DNA, 18 bp, Artificial sequence
  synthetic polynucleotide sequence
cttgggacaatgggggca

SEQ ID NO: 51447 - DNA, 20 bp, Artificial sequence
  synthetic polynucleotide sequence
ctccggaacctgcggaccga

SEQ ID NO: 51448 - DNA, 20 bp, Artificial sequence
  synthetic polynucleotide sequence
aagtggcgcccgcaggtaca

SEQ ID NO: 51449 - DNA, 20 bp, Artificial sequence
  synthetic polynucleotide sequence
gtgacccagcaccttcacca

SEQ ID NO: 51450 - DNA, 25 bp, Artificial sequence
  synthetic polynucleotide sequence
gcaaccaaacgagatgcagttacca

SEQ ID NO: 51451 - DNA, 21 bp, Artificial sequence
  synthetic polynucleotide sequence
cccaaggaaggagggcagaga

SEQ ID NO: 51452 - DNA, 21 bp, Artificial sequence
  synthetic polynucleotide sequence
atgctgctgagagaggcctga

SEQ ID NO: 51453 - DNA, 20 bp, Artificial sequence
  synthetic polynucleotide sequence
ccaggcactgccaagtggaa

SEQ ID NO: 51454 - DNA, 20 bp, Artificial sequence
  synthetic polynucleotide sequence
agttgaccggctccagggga

SEQ ID NO: 51455 - DNA, 21 bp, Artificial sequence
  synthetic polynucleotide sequence
ctgatgagaagcccagtccca

SEQ ID NO: 51456 - DNA, 21 bp, Artificial sequence
  synthetic polynucleotide sequence
ttctccccaaaggctttccca

SEQ ID NO: 51457 - DNA, 22 bp, Artificial sequence
  synthetic polynucleotide sequence
gcagacaagatggcttccggga

SEQ ID NO: 51458 - DNA, 20 bp, Artificial sequence
  synthetic polynucleotide sequence
gcaggtcacaggcccacaga

SEQ ID NO: 51459 - DNA, 20 bp, Artificial sequence
  synthetic polynucleotide sequence
accgtgcccagccaagaaca

SEQ ID NO: 51460 - DNA, 22 bp, Artificial sequence
  synthetic polynucleotide sequence
aaggtccccagtcacatcaaca

SEQ ID NO: 51461 - DNA, 21 bp, Artificial sequence
  synthetic polynucleotide sequence
accttccgccagagctaggca

SEQ ID NO: 51462 - DNA, 19 bp, Artificial sequence
  synthetic polynucleotide sequence
tgcacctcacactcaccca

SEQ ID NO: 51463 - DNA, 21 bp, Artificial sequence
  synthetic polynucleotide sequence
caccaccgctgcagaacagaa

SEQ ID NO: 51464 - DNA, 20 bp, Artificial sequence
  synthetic polynucleotide sequence
tccagggtagaaggcgtgga

SEQ ID NO: 51465 - DNA, 19 bp, Artificial sequence
  synthetic polynucleotide sequence
tcactgcagaggagtggca

SEQ ID NO: 51466 - DNA, 19 bp, Artificial sequence
  synthetic polynucleotide sequence
tcgctccctccaccatcca

SEQ ID NO: 51467 - DNA, 19 bp, Artificial sequence
  synthetic polynucleotide sequence
ggagcctgacagcacgaca

SEQ ID NO: 51468 - DNA, 18 bp, Artificial sequence
  synthetic polynucleotide sequence
caagccacagtcgaggca

SEQ ID NO: 51469 - DNA, 21 bp, Artificial sequence
  synthetic polynucleotide sequence
ggaagcgcaccagtggatcca

SEQ ID NO: 51470 - DNA, 20 bp, Artificial sequence
  synthetic polynucleotide sequence
tgggtagtgccggaagagca

SEQ ID NO: 51471 - DNA, 19 bp, Artificial sequence
  synthetic polynucleotide sequence
gaagccctacccctgccca

SEQ ID NO: 51472 - DNA, 20 bp, Artificial sequence
  synthetic polynucleotide sequence
cttctcccccgtgtgcagca

SEQ ID NO: 51473 - DNA, 18 bp, Artificial sequence
  synthetic polynucleotide sequence
tgtgcatcaccggaccca

SEQ ID NO: 51474 - DNA, 18 bp, Artificial sequence
  synthetic polynucleotide sequence
tcgctgaaggtccgccca

SEQ ID NO: 51475 - DNA, 21 bp, Artificial sequence
  synthetic polynucleotide sequence
tagcccctcaagagtcaccca

SEQ ID NO: 51476 - DNA, 21 bp, Artificial sequence
  synthetic polynucleotide sequence
ggaagcagggttggagcctga

SEQ ID NO: 51477 - DNA, 20 bp, Artificial sequence
  synthetic polynucleotide sequence
aacccgtacgagtgccggga

SEQ ID NO: 51478 - DNA, 20 bp, Artificial sequence
  synthetic polynucleotide sequence
ccgcagtcctggcaggcgaa

SEQ ID NO: 51479 - DNA, 21 bp, Artificial sequence
  synthetic polynucleotide sequence
cctgaagagaggctgaggaca

SEQ ID NO: 51480 - DNA, 20 bp, Artificial sequence
  synthetic polynucleotide sequence
cctagcagctgagctggaga

SEQ ID NO: 51481 - DNA, 21 bp, Artificial sequence
  synthetic polynucleotide sequence
tcacagcggagagaagccgta

SEQ ID NO: 51482 - DNA, 21 bp, Artificial sequence
  synthetic polynucleotide sequence
tggatcctaagggctgaggga

SEQ ID NO: 51483 - DNA, 21 bp, Artificial sequence
  synthetic polynucleotide sequence
ccctagcccagcatcaaagga

SEQ ID NO: 51484 - DNA, 21 bp, Artificial sequence
  synthetic polynucleotide sequence
ctgactcaggcgagagatcca

SEQ ID NO: 51485 - DNA, 20 bp, Artificial sequence
  synthetic polynucleotide sequence
gaagagcccagtccatgcga

SEQ ID NO: 51486 - DNA, 20 bp, Artificial sequence
  synthetic polynucleotide sequence
tcccacactctcgacacgca

SEQ ID NO: 51487 - DNA, 20 bp, Artificial sequence
  synthetic polynucleotide sequence
tacccaggttccagatgaca

SEQ ID NO: 51488 - DNA, 22 bp, Artificial sequence
  synthetic polynucleotide sequence
ctaatggatgggcgatacctga

SEQ ID NO: 51489 - DNA, 21 bp, Artificial sequence
  synthetic polynucleotide sequence
gaagtggtccacacagggaca

SEQ ID NO: 51490 - DNA, 21 bp, Artificial sequence
  synthetic polynucleotide sequence
gtgcacttcaggcagatgcga

SEQ ID NO: 51491 - DNA, 20 bp, Artificial sequence
  synthetic polynucleotide sequence
tctccctacaagccgggcca

SEQ ID NO: 51492 - DNA, 20 bp, Artificial sequence
  synthetic polynucleotide sequence
aggccaggcacgaactgaga

SEQ ID NO: 51493 - DNA, 21 bp, Artificial sequence
  synthetic polynucleotide sequence
agttcacccccaatggcagca

SEQ ID NO: 51494 - DNA, 19 bp, Artificial sequence
  synthetic polynucleotide sequence
ggacaggaccgtgtgcgca

SEQ ID NO: 51495 - DNA, 20 bp, Artificial sequence
  synthetic polynucleotide sequence
acagccgaacctgtcagcca

SEQ ID NO: 51496 - DNA, 20 bp, Artificial sequence
  synthetic polynucleotide sequence
ggagggcccctctgtgagaa

SEQ ID NO: 51497 - DNA, 23 bp, Artificial sequence
  synthetic polynucleotide sequence
catgagagaactcaccttggaca

SEQ ID NO: 51498 - DNA, 23 bp, Artificial sequence
  synthetic polynucleotide sequence
ccttcccacatagaagacaagca

SEQ ID NO: 51499 - DNA, 18 bp, Artificial sequence
  synthetic polynucleotide sequence
ggctcgtggacagcagaa

SEQ ID NO: 51500 - DNA, 20 bp, Artificial sequence
  synthetic polynucleotide sequence
gaaggtcttagggtctggca

SEQ ID NO: 51501 - DNA, 21 bp, Artificial sequence
  synthetic polynucleotide sequence
caaagccttccggaccaagga

SEQ ID NO: 51502 - DNA, 20 bp, Artificial sequence
  synthetic polynucleotide sequence
gaagcccttgggccaccgga

SEQ ID NO: 51503 - DNA, 21 bp, Artificial sequence
  synthetic polynucleotide sequence
aatgtgtccaccaggcaacca

SEQ ID NO: 51504 - DNA, 22 bp, Artificial sequence
  synthetic polynucleotide sequence
agagatgaggtgagtcagagca

SEQ ID NO: 51505 - DNA, 20 bp, Artificial sequence
  synthetic polynucleotide sequence
aagccctacgtgtgcggcga

SEQ ID NO: 51506 - DNA, 20 bp, Artificial sequence
  synthetic polynucleotide sequence
gccgcactcgctgcactcga

SEQ ID NO: 51507 - DNA, 20 bp, Artificial sequence
  synthetic polynucleotide sequence
cacctgcacgccggcagcaa

SEQ ID NO: 51508 - DNA, 20 bp, Artificial sequence
  synthetic polynucleotide sequence
ggccgatgtccatgacgcca

SEQ ID NO: 51509 - DNA, 22 bp, Artificial sequence
  synthetic polynucleotide sequence
tcaagtgaccttaagcggcaca

SEQ ID NO: 51510 - DNA, 22 bp, Artificial sequence
  synthetic polynucleotide sequence
aaagtcacagtgcctgcactga

SEQ ID NO: 51511 - DNA, 20 bp, Artificial sequence
  synthetic polynucleotide sequence
accagagaggagtgggacca

SEQ ID NO: 51512 - DNA, 22 bp, Artificial sequence
  synthetic polynucleotide sequence
acaaagctgataccccagtgca

SEQ ID NO: 51513 - DNA, 20 bp, Artificial sequence
  synthetic polynucleotide sequence
cagaaactccaggtggccca

SEQ ID NO: 51514 - DNA, 22 bp, Artificial sequence
  synthetic polynucleotide sequence
cccagcacattgcatgggagaa

SEQ ID NO: 51515 - DNA, 21 bp, Artificial sequence
  synthetic polynucleotide sequence
gagacctacagcagcctggta

SEQ ID NO: 51516 - DNA, 19 bp, Artificial sequence
  synthetic polynucleotide sequence
ccaccaggctcctgtggca

SEQ ID NO: 51517 - DNA, 22 bp, Artificial sequence
  synthetic polynucleotide sequence
tactggagagaacccctacaca

SEQ ID NO: 51518 - DNA, 20 bp, Artificial sequence
  synthetic polynucleotide sequence
tagtaaggtgtgaggaccga

SEQ ID NO: 51519 - DNA, 21 bp, Artificial sequence
  synthetic polynucleotide sequence
gacagtagccatccagccaga

SEQ ID NO: 51520 - DNA, 19 bp, Artificial sequence
  synthetic polynucleotide sequence
ctgagggccacagctccca

SEQ ID NO: 51521 - DNA, 20 bp, Artificial sequence
  synthetic polynucleotide sequence
tgccccatcaacagacctga

SEQ ID NO: 51522 - DNA, 22 bp, Artificial sequence
  synthetic polynucleotide sequence
ccatccaaaggatctgccacga

SEQ ID NO: 51523 - DNA, 20 bp, Artificial sequence
  synthetic polynucleotide sequence
gaacatccggaggctgggaa

SEQ ID NO: 51524 - DNA, 20 bp, Artificial sequence
  synthetic polynucleotide sequence
gcagagtccaggcattccca

SEQ ID NO: 51525 - DNA, 25 bp, Artificial sequence
  synthetic polynucleotide sequence
gagagaagccctgcaaatgtgaaga

SEQ ID NO: 51526 - DNA, 20 bp, Artificial sequence
  synthetic polynucleotide sequence
aggcttgagggccagctgaa

SEQ ID NO: 51527 - DNA, 21 bp, Artificial sequence
  synthetic polynucleotide sequence
ggcagcctagaaatgggacca

SEQ ID NO: 51528 - DNA, 23 bp, Artificial sequence
  synthetic polynucleotide sequence
gacagccatacccaggaagacca

SEQ ID NO: 51529 - DNA, 21 bp, Artificial sequence
  synthetic polynucleotide sequence
actggagagaaaccctacgca

SEQ ID NO: 51530 - DNA, 22 bp, Artificial sequence
  synthetic polynucleotide sequence
aatgagggctgaggatacgcta

SEQ ID NO: 51531 - DNA, 22 bp, Artificial sequence
  synthetic polynucleotide sequence
attctccccagaagagtgggaa

SEQ ID NO: 51532 - DNA, 22 bp, Artificial sequence
  synthetic polynucleotide sequence
atagcaagacccaaggagacca

SEQ ID NO: 51533 - DNA, 20 bp, Artificial sequence
  synthetic polynucleotide sequence
gttcccactgcagccagcaa

SEQ ID NO: 51534 - DNA, 20 bp, Artificial sequence
  synthetic polynucleotide sequence
cggtgaccctgactcgagca

SEQ ID NO: 51535 - DNA, 20 bp, Artificial sequence
  synthetic polynucleotide sequence
cgcaagcaccagcgcaacca

SEQ ID NO: 51536 - DNA, 19 bp, Artificial sequence
  synthetic polynucleotide sequence
ccatcggtgggtcccagga

SEQ ID NO: 51537 - DNA, 18 bp, Artificial sequence
  synthetic polynucleotide sequence
gcgggagacctacggcca

SEQ ID NO: 51538 - DNA, 19 bp, Artificial sequence
  synthetic polynucleotide sequence
cacctccggatcctgggca

SEQ ID NO: 51539 - DNA, 22 bp, Artificial sequence
  synthetic polynucleotide sequence
atgacctgcaccaaaaggagca

SEQ ID NO: 51540 - DNA, 21 bp, Artificial sequence
  synthetic polynucleotide sequence
tggagaaggtctgagctggca

SEQ ID NO: 51541 - DNA, 20 bp, Artificial sequence
  synthetic polynucleotide sequence
gactctacccgccagagcaa

SEQ ID NO: 51542 - DNA, 18 bp, Artificial sequence
  synthetic polynucleotide sequence
gcggcctccgagacgaga

SEQ ID NO: 51543 - DNA, 19 bp, Artificial sequence
  synthetic polynucleotide sequence
acaccggagaacccacaca

SEQ ID NO: 51544 - DNA, 22 bp, Artificial sequence
  synthetic polynucleotide sequence
tcagaatgaggacactggacaa

SEQ ID NO: 51545 - DNA, 22 bp, Artificial sequence
  synthetic polynucleotide sequence
atcaagaccaggactcagggaa

SEQ ID NO: 51546 - DNA, 21 bp, Artificial sequence
  synthetic polynucleotide sequence
tgggtactcaggagagaagca

SEQ ID NO: 51547 - DNA, 22 bp, Artificial sequence
  synthetic polynucleotide sequence
agaaatggccatgaagcaccca

SEQ ID NO: 51548 - DNA, 22 bp, Artificial sequence
  synthetic polynucleotide sequence
gaaaccaaggaagcatcgtgga

SEQ ID NO: 51549 - DNA, 20 bp, Artificial sequence
  synthetic polynucleotide sequence
actggggagaagccctgtga

SEQ ID NO: 51550 - DNA, 22 bp, Artificial sequence
  synthetic polynucleotide sequence
atgtctacgaagggaactggga

SEQ ID NO: 51551 - DNA, 22 bp, Artificial sequence
  synthetic polynucleotide sequence
cctaggctccgacaaaaccaca

SEQ ID NO: 51552 - DNA, 18 bp, Artificial sequence
  synthetic polynucleotide sequence
ggatgggtggccgggcca

SEQ ID NO: 51553 - DNA, 21 bp, Artificial sequence
  synthetic polynucleotide sequence
tgacattcagggacgtggcca

SEQ ID NO: 51554 - DNA, 22 bp, Artificial sequence
  synthetic polynucleotide sequence
ggaagacagattcccagggaga

SEQ ID NO: 51555 - DNA, 21 bp, Artificial sequence
  synthetic polynucleotide sequence
ctccactctcatccagcacca

SEQ ID NO: 51556 - DNA, 20 bp, Artificial sequence
  synthetic polynucleotide sequence
atgaggtcggagctctggga

SEQ ID NO: 51557 - DNA, 21 bp, Artificial sequence
  synthetic polynucleotide sequence
tgaggacgcacactggagaga

SEQ ID NO: 51558 - DNA, 21 bp, Artificial sequence
  synthetic polynucleotide sequence
ccttcccacactgcttgcaca

SEQ ID NO: 51559 - DNA, 19 bp, Artificial sequence
  synthetic polynucleotide sequence
tcctggtagcaccgggcaa

SEQ ID NO: 51560 - DNA, 22 bp, Artificial sequence
  synthetic polynucleotide sequence
caaacactgcatcggtacagga

SEQ ID NO: 51561 - DNA, 21 bp, Artificial sequence
  synthetic polynucleotide sequence
acacacccagggcagaaacca

SEQ ID NO: 51562 - DNA, 20 bp, Artificial sequence
  synthetic polynucleotide sequence
tacaagcctcccctgtcaca

SEQ ID NO: 51563 - DNA, 21 bp, Artificial sequence
  synthetic polynucleotide sequence
ccaaagctcaagcctcatgca

SEQ ID NO: 51564 - DNA, 21 bp, Artificial sequence
  synthetic polynucleotide sequence
caagactggagctgtggcgaa

SEQ ID NO: 51565 - DNA, 22 bp, Artificial sequence
  synthetic polynucleotide sequence
accaacgaatccacaccggaga

SEQ ID NO: 51566 - DNA, 22 bp, Artificial sequence
  synthetic polynucleotide sequence
aggtcttgccacactcaggaca

SEQ ID NO: 51567 - DNA, 20 bp, Artificial sequence
  synthetic polynucleotide sequence
ccccaggcttcaagcaccga

SEQ ID NO: 51568 - DNA, 20 bp, Artificial sequence
  synthetic polynucleotide sequence
atcctgaagcgtgggcagga

SEQ ID NO: 51569 - DNA, 22 bp, Artificial sequence
  synthetic polynucleotide sequence
atcagcgagttcacactggaga

SEQ ID NO: 51570 - DNA, 21 bp, Artificial sequence
  synthetic polynucleotide sequence
ttcccacatgccgtacactca

SEQ ID NO: 51571 - DNA, 20 bp, Artificial sequence
  synthetic polynucleotide sequence
aagccctacaagtgccccga

SEQ ID NO: 51572 - DNA, 21 bp, Artificial sequence
  synthetic polynucleotide sequence
gcacgcgctgatggatcacca

SEQ ID NO: 51573 - DNA, 20 bp, Artificial sequence
  synthetic polynucleotide sequence
actccatgggctgcgccaca

SEQ ID NO: 51574 - DNA, 20 bp, Artificial sequence
  synthetic polynucleotide sequence
cagggtggacttgcacgcga

SEQ ID NO: 51575 - DNA, 21 bp, Artificial sequence
  synthetic polynucleotide sequence
aagcccgaggaagattgacca

SEQ ID NO: 51576 - DNA, 20 bp, Artificial sequence
  synthetic polynucleotide sequence
ctctgatcaggctgcaggca

SEQ ID NO: 51577 - DNA, 20 bp, Artificial sequence
  synthetic polynucleotide sequence
ctgacacagcttgctcgaca

SEQ ID NO: 51578 - DNA, 22 bp, Artificial sequence
  synthetic polynucleotide sequence
ttgaacaaggttcgagccacga

SEQ ID NO: 51579 - DNA, 21 bp, Artificial sequence
  synthetic polynucleotide sequence
ggcctttaagcagagagccca

SEQ ID NO: 51580 - DNA, 21 bp, Artificial sequence
  synthetic polynucleotide sequence
acaagcaaaggccttcccaca

SEQ ID NO: 51581 - DNA, 22 bp, Artificial sequence
  synthetic polynucleotide sequence
aaccctcccagtgcatcagaga

SEQ ID NO: 51582 - DNA, 21 bp, Artificial sequence
  synthetic polynucleotide sequence
ggctttcccgcactcaggaca

SEQ ID NO: 51583 - DNA, 21 bp, Artificial sequence
  synthetic polynucleotide sequence
accgagtgtagaatcccccga

SEQ ID NO: 51584 - DNA, 21 bp, Artificial sequence
  synthetic polynucleotide sequence
tcctccacatgggtccgctga

SEQ ID NO: 51585 - DNA, 20 bp, Artificial sequence
  synthetic polynucleotide sequence
ggtgaaggtgacggacacca

SEQ ID NO: 51586 - DNA, 20 bp, Artificial sequence
  synthetic polynucleotide sequence
tcgtggaacagcagctcgga

SEQ ID NO: 51587 - DNA, 20 bp, Artificial sequence
  synthetic polynucleotide sequence
ccggcgcattcactccgaca

SEQ ID NO: 51588 - DNA, 20 bp, Artificial sequence
  synthetic polynucleotide sequence
ctcgctgcaggagcggtgga

SEQ ID NO: 51589 - DNA, 18 bp, Artificial sequence
  synthetic polynucleotide sequence
gtgcaagctccgtgagca

SEQ ID NO: 51590 - DNA, 18 bp, Artificial sequence
  synthetic polynucleotide sequence
cttgccacactccccgca

SEQ ID NO: 51591 - DNA, 21 bp, Artificial sequence
  synthetic polynucleotide sequence
gccgcagcttcactcagagca

SEQ ID NO: 51592 - DNA, 18 bp, Artificial sequence
  synthetic polynucleotide sequence
ccagcaccttggccgcca

SEQ ID NO: 51593 - DNA, 22 bp, Artificial sequence
  synthetic polynucleotide sequence
agatctgcctcacacctacgaa

SEQ ID NO: 51594 - DNA, 21 bp, Artificial sequence
  synthetic polynucleotide sequence
cgaaggccactccagtaacga

SEQ ID NO: 51595 - DNA, 21 bp, Artificial sequence
  synthetic polynucleotide sequence
caagccttcagacagcggtca

SEQ ID NO: 51596 - DNA, 21 bp, Artificial sequence
  synthetic polynucleotide sequence
acaagatacgcgagctgccga

SEQ ID NO: 51597 - DNA, 22 bp, Artificial sequence
  synthetic polynucleotide sequence
aacctcacgaaccatcagagga

SEQ ID NO: 51598 - DNA, 20 bp, Artificial sequence
  synthetic polynucleotide sequence
aggccttcccacacgcggca

SEQ ID NO: 51599 - DNA, 21 bp, Artificial sequence
  synthetic polynucleotide sequence
cctggacctggaacagaggga

SEQ ID NO: 51600 - DNA, 20 bp, Artificial sequence
  synthetic polynucleotide sequence
ggtctgacacctcgactgca

SEQ ID NO: 51601 - DNA, 18 bp, Artificial sequence
  synthetic polynucleotide sequence
agggacaacaccgggaca

SEQ ID NO: 51602 - DNA, 18 bp, Artificial sequence
  synthetic polynucleotide sequence
aggagccagcagagccca

SEQ ID NO: 51603 - DNA, 21 bp, Artificial sequence
  synthetic polynucleotide sequence
tcagccacattgccagcctca

SEQ ID NO: 51604 - DNA, 21 bp, Artificial sequence
  synthetic polynucleotide sequence
cattcataaggccgctcacca

SEQ ID NO: 51605 - DNA, 21 bp, Artificial sequence
  synthetic polynucleotide sequence
gctttcacccagaacccggca

SEQ ID NO: 51606 - DNA, 21 bp, Artificial sequence
  synthetic polynucleotide sequence
gtagcagaaggctttcccaca

SEQ ID NO: 51607 - DNA, 19 bp, Artificial sequence
  synthetic polynucleotide sequence
tggtgctgggcacaaacca

SEQ ID NO: 51608 - DNA, 20 bp, Artificial sequence
  synthetic polynucleotide sequence
atctccacgctgcactgcca

SEQ ID NO: 51609 - DNA, 21 bp, Artificial sequence
  synthetic polynucleotide sequence
gacgccagctctcacaaagca

SEQ ID NO: 51610 - DNA, 21 bp, Artificial sequence
  synthetic polynucleotide sequence
atctggtgccggatgaggtga

SEQ ID NO: 51611 - DNA, 21 bp, Artificial sequence
  synthetic polynucleotide sequence
acctcctgtgctaccgccaga

SEQ ID NO: 51612 - DNA, 20 bp, Artificial sequence
  synthetic polynucleotide sequence
ctccagtgtgggtcacacga

SEQ ID NO: 51613 - DNA, 22 bp, Artificial sequence
  synthetic polynucleotide sequence
atgaacaacctcaggagtcgca

SEQ ID NO: 51614 - DNA, 20 bp, Artificial sequence
  synthetic polynucleotide sequence
cggcgaacacctcgtctaga

SEQ ID NO: 51615 - DNA, 18 bp, Artificial sequence
  synthetic polynucleotide sequence
gtcctgggaaccagccaa

SEQ ID NO: 51616 - DNA, 21 bp, Artificial sequence
  synthetic polynucleotide sequence
gatgacagtagggtgtgggga

SEQ ID NO: 51617 - DNA, 22 bp, Artificial sequence
  synthetic polynucleotide sequence
agatcctacagctacaagccca

SEQ ID NO: 51618 - DNA, 18 bp, Artificial sequence
  synthetic polynucleotide sequence
tacggttgaggccggaga

SEQ ID NO: 51619 - DNA, 22 bp, Artificial sequence
  synthetic polynucleotide sequence
ataaaagggcccacactggaga

SEQ ID NO: 51620 - DNA, 19 bp, Artificial sequence
  synthetic polynucleotide sequence
tccacactccatgcactca

SEQ ID NO: 51621 - DNA, 22 bp, Artificial sequence
  synthetic polynucleotide sequence
gtaattcacagctggcacgaca

SEQ ID NO: 51622 - DNA, 20 bp, Artificial sequence
  synthetic polynucleotide sequence
atacaagggatgcccggtga

SEQ ID NO: 51623 - DNA, 20 bp, Artificial sequence
  synthetic polynucleotide sequence
ctccctgaactcagccctca

SEQ ID NO: 51624 - DNA, 21 bp, Artificial sequence
  synthetic polynucleotide sequence
ttctggatgaaggcctgccca

SEQ ID NO: 51625 - DNA, 20 bp, Artificial sequence
  synthetic polynucleotide sequence
tgactggtagtgcagaccga

SEQ ID NO: 51626 - DNA, 21 bp, Artificial sequence
  synthetic polynucleotide sequence
gtggagttcaggcagatgcga

SEQ ID NO: 51627 - DNA, 21 bp, Artificial sequence
  synthetic polynucleotide sequence
ctggggagaagtcaaacagca

SEQ ID NO: 51628 - DNA, 20 bp, Artificial sequence
  synthetic polynucleotide sequence
cttcccacattcacagcaca

SEQ ID NO: 51629 - DNA, 22 bp, Artificial sequence
  synthetic polynucleotide sequence
agaaatggccatgaagcaccca

SEQ ID NO: 51630 - DNA, 21 bp, Artificial sequence
  synthetic polynucleotide sequence
gtggagttcaggcagatgcga

SEQ ID NO: 51631 - DNA, 21 bp, Artificial sequence
  synthetic polynucleotide sequence
gaggggtggtcaaagtggaga

SEQ ID NO: 51632 - DNA, 20 bp, Artificial sequence
  synthetic polynucleotide sequence
ctcccgcagtctagctggca

SEQ ID NO: 51633 - DNA, 21 bp, Artificial sequence
  synthetic polynucleotide sequence
acacaggagatggaccccaga

SEQ ID NO: 51634 - DNA, 21 bp, Artificial sequence
  synthetic polynucleotide sequence
tgtcttcgaagggaaccggca

SEQ ID NO: 51635 - DNA, 20 bp, Artificial sequence
  synthetic polynucleotide sequence
acaggaagacccccagcgaa

SEQ ID NO: 51636 - DNA, 20 bp, Artificial sequence
  synthetic polynucleotide sequence
gctggctcccaggcatgaca

SEQ ID NO: 51637 - DNA, 21 bp, Artificial sequence
  synthetic polynucleotide sequence
tgtcacccagaagaggaggaa

SEQ ID NO: 51638 - DNA, 21 bp, Artificial sequence
  synthetic polynucleotide sequence
catctgatcagcgtccaggca

SEQ ID NO: 51639 - DNA, 22 bp, Artificial sequence
  synthetic polynucleotide sequence
tcatccctagcacatcatcgga

SEQ ID NO: 51640 - DNA, 22 bp, Artificial sequence
  synthetic polynucleotide sequence
attgtcgcggaagagtttgcca

SEQ ID NO: 51641 - DNA, 18 bp, Artificial sequence
  synthetic polynucleotide sequence
gcggaagcgttaccggaa

SEQ ID NO: 51642 - DNA, 18 bp, Artificial sequence
  synthetic polynucleotide sequence
ccccaatctggcggtcca

SEQ ID NO: 51643 - DNA, 20 bp, Artificial sequence
  synthetic polynucleotide sequence
gcactgctgccacatcagga

SEQ ID NO: 51644 - DNA, 20 bp, Artificial sequence
  synthetic polynucleotide sequence
gctgagtctccagcaaccca

SEQ ID NO: 51645 - DNA, 20 bp, Artificial sequence
  synthetic polynucleotide sequence
catcgtgcacaccggggaga

SEQ ID NO: 51646 - DNA, 20 bp, Artificial sequence
  synthetic polynucleotide sequence
ctcctccctgtgagagccca

SEQ ID NO: 51647 - DNA, 22 bp, Artificial sequence
  synthetic polynucleotide sequence
tcaacactagcacgtcatcgga

SEQ ID NO: 51648 - DNA, 21 bp, Artificial sequence
  synthetic polynucleotide sequence
ttgaggcaagaaaaccgccca

SEQ ID NO: 51649 - DNA, 20 bp, Artificial sequence
  synthetic polynucleotide sequence
accagcgtcctgcctacaga

SEQ ID NO: 51650 - DNA, 21 bp, Artificial sequence
  synthetic polynucleotide sequence
ccagagtgcacctccatccca

SEQ ID NO: 51651 - DNA, 21 bp, Artificial sequence
  synthetic polynucleotide sequence
cacatcccatcagcggacaca

SEQ ID NO: 51652 - DNA, 20 bp, Artificial sequence
  synthetic polynucleotide sequence
tccgggagaaggctttccca

SEQ ID NO: 51653 - DNA, 22 bp, Artificial sequence
  synthetic polynucleotide sequence
ggaactcaagcctcactgcaca

SEQ ID NO: 51654 - DNA, 20 bp, Artificial sequence
  synthetic polynucleotide sequence
cggtgccctgcaagacgtga

SEQ ID NO: 51655 - DNA, 20 bp, Artificial sequence
  synthetic polynucleotide sequence
tagagctgacactgcacaca

SEQ ID NO: 51656 - DNA, 21 bp, Artificial sequence
  synthetic polynucleotide sequence
agacaagggcaggctttccca

SEQ ID NO: 51657 - DNA, 21 bp, Artificial sequence
  synthetic polynucleotide sequence
gtggcaaggccttcagtcaga

SEQ ID NO: 51658 - DNA, 21 bp, Artificial sequence
  synthetic polynucleotide sequence
gccaggtgtgaatcacgccca

SEQ ID NO: 51659 - DNA, 21 bp, Artificial sequence
  synthetic polynucleotide sequence
gacaggaacatcgagaagcca

SEQ ID NO: 51660 - DNA, 20 bp, Artificial sequence
  synthetic polynucleotide sequence
gggtaaagtccacagccaca

SEQ ID NO: 51661 - DNA, 21 bp, Artificial sequence
  synthetic polynucleotide sequence
cctggacgctgctcagaagga

SEQ ID NO: 51662 - DNA, 21 bp, Artificial sequence
  synthetic polynucleotide sequence
catctctgacactggagccca

SEQ ID NO: 51663 - DNA, 22 bp, Artificial sequence
  synthetic polynucleotide sequence
cgtatgaggacctgtctgagga

SEQ ID NO: 51664 - DNA, 22 bp, Artificial sequence
  synthetic polynucleotide sequence
caaagaagccatgctacggtca

SEQ ID NO: 51665 - DNA, 20 bp, Artificial sequence
  synthetic polynucleotide sequence
ggcaagggcttctcgcagca

SEQ ID NO: 51666 - DNA, 19 bp, Artificial sequence
  synthetic polynucleotide sequence
gcttgccacagtccccgca

SEQ ID NO: 51667 - DNA, 22 bp, Artificial sequence
  synthetic polynucleotide sequence
aacaagcaacccttgcacgtca

SEQ ID NO: 51668 - DNA, 22 bp, Artificial sequence
  synthetic polynucleotide sequence
agcttgactgaaggcctcgtca

SEQ ID NO: 51669 - DNA, 19 bp, Artificial sequence
  synthetic polynucleotide sequence
gagcgggggttcaaggcca

SEQ ID NO: 51670 - DNA, 20 bp, Artificial sequence
  synthetic polynucleotide sequence
ctgaaacgccggcctgagga

SEQ ID NO: 51671 - DNA, 20 bp, Artificial sequence
  synthetic polynucleotide sequence
cttgctcctacaccgccgca

SEQ ID NO: 51672 - DNA, 19 bp, Artificial sequence
  synthetic polynucleotide sequence
cgctcgccagtgtgcacca

SEQ ID NO: 51673 - DNA, 22 bp, Artificial sequence
  synthetic polynucleotide sequence
gaaaggacacacactggagaga

SEQ ID NO: 51674 - DNA, 22 bp, Artificial sequence
  synthetic polynucleotide sequence
tgaaggactgaggcagatctga

SEQ ID NO: 51675 - DNA, 20 bp, Artificial sequence
  synthetic polynucleotide sequence
ctgccagcccatgtacagga

SEQ ID NO: 51676 - DNA, 22 bp, Artificial sequence
  synthetic polynucleotide sequence
aagagaatccccagtgagacca

SEQ ID NO: 51677 - DNA, 22 bp, Artificial sequence
  synthetic polynucleotide sequence
tacagggaagtgatggtggaga

SEQ ID NO: 51678 - DNA, 19 bp, Artificial sequence
  synthetic polynucleotide sequence
gcactccctgccacctgga

SEQ ID NO: 51679 - DNA, 21 bp, Artificial sequence
  synthetic polynucleotide sequence
gaagtgtcgcatgcccagaga

SEQ ID NO: 51680 - DNA, 21 bp, Artificial sequence
  synthetic polynucleotide sequence
caggaagagatgcacagggca

SEQ ID NO: 51681 - DNA, 19 bp, Artificial sequence
  synthetic polynucleotide sequence
tgtgggaggaaccatccaa

SEQ ID NO: 51682 - DNA, 21 bp, Artificial sequence
  synthetic polynucleotide sequence
gcctccaatgtccccctggaa

SEQ ID NO: 51683 - DNA, 20 bp, Artificial sequence
  synthetic polynucleotide sequence
gaggttgcacaccggagaga

SEQ ID NO: 51684 - DNA, 20 bp, Artificial sequence
  synthetic polynucleotide sequence
ggcctcccaaagtagtggga

SEQ ID NO: 51685 - DNA, 20 bp, Artificial sequence
  synthetic polynucleotide sequence
aagccagacctgatcgccca

SEQ ID NO: 51686 - DNA, 21 bp, Artificial sequence
  synthetic polynucleotide sequence
tctggccaaagatcttgggca

SEQ ID NO: 51687 - DNA, 18 bp, Artificial sequence
  synthetic polynucleotide sequence
tctgagccctgcaaccga

SEQ ID NO: 51688 - DNA, 18 bp, Artificial sequence
  synthetic polynucleotide sequence
catgtggcagatccggca

SEQ ID NO: 51689 - DNA, 21 bp, Artificial sequence
  synthetic polynucleotide sequence
ccgagggccctaactacctga

SEQ ID NO: 51690 - DNA, 20 bp, Artificial sequence
  synthetic polynucleotide sequence
gcacagtgcagtaccgggca

SEQ ID NO: 51691 - DNA, 21 bp, Artificial sequence
  synthetic polynucleotide sequence
gatctgcttggagaagcccaa

SEQ ID NO: 51692 - DNA, 21 bp, Artificial sequence
  synthetic polynucleotide sequence
cttccggaagcagactaccga

SEQ ID NO: 51693 - DNA, 20 bp, Artificial sequence
  synthetic polynucleotide sequence
aatcacccggtgggctgcaa

SEQ ID NO: 51694 - DNA, 20 bp, Artificial sequence
  synthetic polynucleotide sequence
acacagggcaaactgcagga

SEQ ID NO: 51695 - DNA, 19 bp, Artificial sequence
  synthetic polynucleotide sequence
ggggctcaggatacggtca

SEQ ID NO: 51696 - DNA, 19 bp, Artificial sequence
  synthetic polynucleotide sequence
tcctccaccgacataggca

SEQ ID NO: 51697 - DNA, 22 bp, Artificial sequence
  synthetic polynucleotide sequence
aacctcgcctctcctacaacga

SEQ ID NO: 51698 - DNA, 21 bp, Artificial sequence
  synthetic polynucleotide sequence
gatagatgcacaggcagggca

SEQ ID NO: 51699 - DNA, 20 bp, Artificial sequence
  synthetic polynucleotide sequence
gtgcacagcagccctgagga

SEQ ID NO: 51700 - DNA, 22 bp, Artificial sequence
  synthetic polynucleotide sequence
atcctccaaacatgtgcggcga

SEQ ID NO: 51701 - DNA, 20 bp, Artificial sequence
  synthetic polynucleotide sequence
ggactgccaagggacccaca

SEQ ID NO: 51702 - DNA, 19 bp, Artificial sequence
  synthetic polynucleotide sequence
gccctagcctggcagcaca

SEQ ID NO: 51703 - DNA, 18 bp, Artificial sequence
  synthetic polynucleotide sequence
agaaggcccaggtccgca

SEQ ID NO: 51704 - DNA, 18 bp, Artificial sequence
  synthetic polynucleotide sequence
aggtgtgggagcagggca

SEQ ID NO: 51705 - DNA, 21 bp, Artificial sequence
  synthetic polynucleotide sequence
aatgggaactccagcctgaga

SEQ ID NO: 51706 - DNA, 21 bp, Artificial sequence
  synthetic polynucleotide sequence
ctcaggcccacaaagacacca

SEQ ID NO: 51707 - DNA, 22 bp, Artificial sequence
  synthetic polynucleotide sequence
gctatggacaccaaagggcaca

SEQ ID NO: 51708 - DNA, 21 bp, Artificial sequence
  synthetic polynucleotide sequence
gagttgccaccacacctgcaa

SEQ ID NO: 51709 - DNA, 22 bp, Artificial sequence
  synthetic polynucleotide sequence
taaccgcaggcatgtgacagaa

SEQ ID NO: 51710 - DNA, 22 bp, Artificial sequence
  synthetic polynucleotide sequence
accactgaggtgtcagaaggca

SEQ ID NO: 51711 - DNA, 25 bp, Artificial sequence
  synthetic polynucleotide sequence
ctggtccaacaaccaacaacatgga

SEQ ID NO: 51712 - DNA, 20 bp, Artificial sequence
  synthetic polynucleotide sequence
gagtggcagggaacgtgaca

SEQ ID NO: 51713 - DNA, 21 bp, Artificial sequence
  synthetic polynucleotide sequence
acccaagcgatgtacagacca

SEQ ID NO: 51714 - DNA, 20 bp, Artificial sequence
  synthetic polynucleotide sequence
atatgatccagggctgcaga

SEQ ID NO: 51715 - DNA, 22 bp, Artificial sequence
  synthetic polynucleotide sequence
atcctccaggcaagagatcgaa

SEQ ID NO: 51716 - DNA, 22 bp, Artificial sequence
  synthetic polynucleotide sequence
cataggtaaggacggaaacgca

SEQ ID NO: 51717 - DNA, 21 bp, Artificial sequence
  synthetic polynucleotide sequence
cattgagaatggccgaagcca

SEQ ID NO: 51718 - DNA, 21 bp, Artificial sequence
  synthetic polynucleotide sequence
tctgcagagcttggtaacgca

SEQ ID NO: 51719 - DNA, 22 bp, Artificial sequence
  synthetic polynucleotide sequence
ggatcaccctccacatcacaga

SEQ ID NO: 51720 - DNA, 21 bp, Artificial sequence
  synthetic polynucleotide sequence
ctgtcgcccagtgtgaaagga

SEQ ID NO: 51721 - DNA, 19 bp, Artificial sequence
  synthetic polynucleotide sequence
ctgtgtgacggagggggga

SEQ ID NO: 51722 - DNA, 21 bp, Artificial sequence
  synthetic polynucleotide sequence
ttcctctccatcagacaggga

SEQ ID NO: 51723 - DNA, 20 bp, Artificial sequence
  synthetic polynucleotide sequence
atccagctccaggtcccaca

SEQ ID NO: 51724 - DNA, 22 bp, Artificial sequence
  synthetic polynucleotide sequence
ttgaacgggaaccagaatggga

SEQ ID NO: 51725 - DNA, 21 bp, Artificial sequence
  synthetic polynucleotide sequence
atcacaaaggagtccaggcca

SEQ ID NO: 51726 - DNA, 22 bp, Artificial sequence
  synthetic polynucleotide sequence
tgtagagggcttcacagtgaga

SEQ ID NO: 51727 - DNA, 22 bp, Artificial sequence
  synthetic polynucleotide sequence
ggatgactatgaccctgacgca

SEQ ID NO: 51728 - DNA, 19 bp, Artificial sequence
  synthetic polynucleotide sequence
cttgaactcgggcaacaca

SEQ ID NO: 51729 - DNA, 21 bp, Artificial sequence
  synthetic polynucleotide sequence
cacaccaaaggtggtacccaa

SEQ ID NO: 51730 - DNA, 20 bp, Artificial sequence
  synthetic polynucleotide sequence
cccaggtgaagaccatccca

SEQ ID NO: 51731 - DNA, 21 bp, Artificial sequence
  synthetic polynucleotide sequence
ggaggcagtgacggtactgga

SEQ ID NO: 51732 - DNA, 18 bp, Artificial sequence
  synthetic polynucleotide sequence
gccttcccaagggggcca

SEQ ID NO: 51733 - DNA, 18 bp, Artificial sequence
  synthetic polynucleotide sequence
gggcttgtcccgcgggaa

SEQ ID NO: 51734 - DNA, 18 bp, Artificial sequence
  synthetic polynucleotide sequence
tagcgcttccggccgcca

SEQ ID NO: 51735 - DNA, 21 bp, Artificial sequence
  synthetic polynucleotide sequence
agaagctgtgctgcaggagga

SEQ ID NO: 51736 - DNA, 18 bp, Artificial sequence
  synthetic polynucleotide sequence
gccggcagagctctcgga

SEQ ID NO: 51737 - DNA, 20 bp, Artificial sequence
  synthetic polynucleotide sequence
ctcctggaccacacagcaca

SEQ ID NO: 51738 - DNA, 19 bp, Artificial sequence
  synthetic polynucleotide sequence
tggagcgctcactgaagca

SEQ ID NO: 51739 - DNA, 22 bp, Artificial sequence
  synthetic polynucleotide sequence
aaggctttcagcgggaaaggca

SEQ ID NO: 51740 - DNA, 18 bp, Artificial sequence
  synthetic polynucleotide sequence
tgggagctgaggcccgca

SEQ ID NO: 51741 - DNA, 21 bp, Artificial sequence
  synthetic polynucleotide sequence
gtccgaaggcctttgcacaga

SEQ ID NO: 51742 - DNA, 21 bp, Artificial sequence
  synthetic polynucleotide sequence
cagggctgagctacgactgaa

SEQ ID NO: 51743 - DNA, 20 bp, Artificial sequence
  synthetic polynucleotide sequence
gggccttcagccagaggtca

SEQ ID NO: 51744 - DNA, 21 bp, Artificial sequence
  synthetic polynucleotide sequence
aggtgatggaaaagcccggca

SEQ ID NO: 51745 - DNA, 21 bp, Artificial sequence
  synthetic polynucleotide sequence
aggcaccagcgaacccacgaa

SEQ ID NO: 51746 - DNA, 20 bp, Artificial sequence
  synthetic polynucleotide sequence
ctcttccagcagtccccgca

SEQ ID NO: 51747 - DNA, 20 bp, Artificial sequence
  synthetic polynucleotide sequence
catccccattccccaccaca

SEQ ID NO: 51748 - DNA, 21 bp, Artificial sequence
  synthetic polynucleotide sequence
gcagcagccactatactggca

SEQ ID NO: 51749 - DNA, 21 bp, Artificial sequence
  synthetic polynucleotide sequence
acacacaggagagagacccca

SEQ ID NO: 51750 - DNA, 20 bp, Artificial sequence
  synthetic polynucleotide sequence
taccacagtcatgacaccca

SEQ ID NO: 51751 - DNA, 22 bp, Artificial sequence
  synthetic polynucleotide sequence
agcttccttcccaggacagaca

SEQ ID NO: 51752 - DNA, 21 bp, Artificial sequence
  synthetic polynucleotide sequence
ctctggcaaaaggccttccca

SEQ ID NO: 51753 - DNA, 22 bp, Artificial sequence
  synthetic polynucleotide sequence
caatggcctcactcgacacaga

SEQ ID NO: 51754 - DNA, 20 bp, Artificial sequence
  synthetic polynucleotide sequence
ctcaccagtgtggactcgga

SEQ ID NO: 51755 - DNA, 21 bp, Artificial sequence
  synthetic polynucleotide sequence
agaaaaccccatcccaggaga

SEQ ID NO: 51756 - DNA, 21 bp, Artificial sequence
  synthetic polynucleotide sequence
ggcttgtggggagagtgcaca

SEQ ID NO: 51757 - DNA, 21 bp, Artificial sequence
  synthetic polynucleotide sequence
gtccacatgcagggacaggaa

SEQ ID NO: 51758 - DNA, 19 bp, Artificial sequence
  synthetic polynucleotide sequence
gtctgggagggtgtcccca

SEQ ID NO: 51759 - DNA, 21 bp, Artificial sequence
  synthetic polynucleotide sequence
tcacagcgggaacagaggaga

SEQ ID NO: 51760 - DNA, 19 bp, Artificial sequence
  synthetic polynucleotide sequence
tggccatccgggtgactga

SEQ ID NO: 51761 - DNA, 22 bp, Artificial sequence
  synthetic polynucleotide sequence
aggaggtcacacacaggagaca

SEQ ID NO: 51762 - DNA, 20 bp, Artificial sequence
  synthetic polynucleotide sequence
taaggtggactcgtgggcga

SEQ ID NO: 51763 - DNA, 21 bp, Artificial sequence
  synthetic polynucleotide sequence
tcttaggagaggggcaacaca

SEQ ID NO: 51764 - DNA, 22 bp, Artificial sequence
  synthetic polynucleotide sequence
ataagacccgcactctgactga

SEQ ID NO: 51765 - DNA, 20 bp, Artificial sequence
  synthetic polynucleotide sequence
ctgccgccacatcctagcca

SEQ ID NO: 51766 - DNA, 20 bp, Artificial sequence
  synthetic polynucleotide sequence
actccacttgctgcccagga

SEQ ID NO: 51767 - DNA, 20 bp, Artificial sequence
  synthetic polynucleotide sequence
gagaggctcagctggcacca

SEQ ID NO: 51768 - DNA, 20 bp, Artificial sequence
  synthetic polynucleotide sequence
cctccctcagcaggaagcca

SEQ ID NO: 51769 - DNA, 22 bp, Artificial sequence
  synthetic polynucleotide sequence
tgattcaggacctaagcaggga

SEQ ID NO: 51770 - DNA, 21 bp, Artificial sequence
  synthetic polynucleotide sequence
aggggccagcccagatatcca

SEQ ID NO: 51771 - DNA, 21 bp, Artificial sequence
  synthetic polynucleotide sequence
tgtggcccgctatatggagca

SEQ ID NO: 51772 - DNA, 21 bp, Artificial sequence
  synthetic polynucleotide sequence
agcggcgcagaatatcggaca

SEQ ID NO: 51773 - DNA, 21 bp, Artificial sequence
  synthetic polynucleotide sequence
ccacagccgtatcccacacca

SEQ ID NO: 51774 - DNA, 20 bp, Artificial sequence
  synthetic polynucleotide sequence
gagctccatgtagcgggcga

SEQ ID NO: 51775 - DNA, 19 bp, Artificial sequence
  synthetic polynucleotide sequence
ccaccctggccatgaccca

SEQ ID NO: 51776 - DNA, 21 bp, Artificial sequence
  synthetic polynucleotide sequence
tcctcccatgaagtcccacca

SEQ ID NO: 51777 - DNA, 18 bp, Artificial sequence
  synthetic polynucleotide sequence
gccggcggttgtggagga

SEQ ID NO: 51778 - DNA, 19 bp, Artificial sequence
  synthetic polynucleotide sequence
ccaaggcctgggtggctga

SEQ ID NO: 51779 - DNA, 21 bp, Artificial sequence
  synthetic polynucleotide sequence
catccctaccacacagagcca

SEQ ID NO: 51780 - DNA, 19 bp, Artificial sequence
  synthetic polynucleotide sequence
gtggtgcaggctgtgggga

SEQ ID NO: 51781 - DNA, 22 bp, Artificial sequence
  synthetic polynucleotide sequence
aaaacagtccagcctgaccgaa

SEQ ID NO: 51782 - DNA, 20 bp, Artificial sequence
  synthetic polynucleotide sequence
atgagcccacacataggaca

SEQ ID NO: 51783 - DNA, 20 bp, Artificial sequence
  synthetic polynucleotide sequence
gtgatggatgaaggacccca

SEQ ID NO: 51784 - DNA, 20 bp, Artificial sequence
  synthetic polynucleotide sequence
cttcactggaagagaacgca

SEQ ID NO: 51785 - DNA, 18 bp, Artificial sequence
  synthetic polynucleotide sequence
agttgggaaggcaaggca

SEQ ID NO: 51786 - DNA, 22 bp, Artificial sequence
  synthetic polynucleotide sequence
tgataagctcagctcctagcca

SEQ ID NO: 51787 - DNA, 18 bp, Artificial sequence
  synthetic polynucleotide sequence
cgagccgacagaaggcaa

SEQ ID NO: 51788 - DNA, 18 bp, Artificial sequence
  synthetic polynucleotide sequence
agggccttggtgaggcca

SEQ ID NO: 51789 - DNA, 19 bp, Artificial sequence
  synthetic polynucleotide sequence
gctcgactctggcagggca

SEQ ID NO: 51790 - DNA, 21 bp, Artificial sequence
  synthetic polynucleotide sequence
catggccaaagagtccagaga

SEQ ID NO: 51791 - DNA, 19 bp, Artificial sequence
  synthetic polynucleotide sequence
cttcgagcaccccccgaga

SEQ ID NO: 51792 - DNA, 19 bp, Artificial sequence
  synthetic polynucleotide sequence
ggcaacgtggactggggca

SEQ ID NO: 51793 - DNA, 22 bp, Artificial sequence
  synthetic polynucleotide sequence
atagcccacctgacatctgaca

SEQ ID NO: 51794 - DNA, 22 bp, Artificial sequence
  synthetic polynucleotide sequence
gatacatagcccatagtgccca

SEQ ID NO: 51795 - DNA, 21 bp, Artificial sequence
  synthetic polynucleotide sequence
aagcgttacagtgaacgggca

SEQ ID NO: 51796 - DNA, 22 bp, Artificial sequence
  synthetic polynucleotide sequence
aaatgggtcacatcagccagga

SEQ ID NO: 51797 - DNA, 18 bp, Artificial sequence
  synthetic polynucleotide sequence
caaggcctatcacccgca

SEQ ID NO: 51798 - DNA, 19 bp, Artificial sequence
  synthetic polynucleotide sequence
tgtggtagtcggggacaca

SEQ ID NO: 51799 - DNA, 20 bp, Artificial sequence
  synthetic polynucleotide sequence
ctgagccagtactcccagca

SEQ ID NO: 51800 - DNA, 18 bp, Artificial sequence
  synthetic polynucleotide sequence
ctttcagggccagggaca

SEQ ID NO: 51801 - DNA, 21 bp, Artificial sequence
  synthetic polynucleotide sequence
ggcaggcaccagagagaagca

SEQ ID NO: 51802 - DNA, 20 bp, Artificial sequence
  synthetic polynucleotide sequence
gtcccatacgatctcaggca

SEQ ID NO: 51803 - DNA, 20 bp, Artificial sequence
  synthetic polynucleotide sequence
ccccaccatcagccttgcca

SEQ ID NO: 51804 - DNA, 25 bp, Artificial sequence
  synthetic polynucleotide sequence
gaaggggggaaaaagtcacactcaa

SEQ ID NO: 51805 - DNA, 23 bp, Artificial sequence
  synthetic polynucleotide sequence
ctgcaggcatacactgaagtgaa

SEQ ID NO: 51806 - DNA, 21 bp, Artificial sequence
  synthetic polynucleotide sequence
ccatcaatggctgagggagga

SEQ ID NO: 51807 - DNA, 20 bp, Artificial sequence
  synthetic polynucleotide sequence
ccacctgtgcaacccatgca

SEQ ID NO: 51808 - DNA, 18 bp, Artificial sequence
  synthetic polynucleotide sequence
caggggccgcagggggaa

SEQ ID NO: 51809 - DNA, 19 bp, Artificial sequence
  synthetic polynucleotide sequence
ctggctactaccgaccgga

SEQ ID NO: 51810 - DNA, 18 bp, Artificial sequence
  synthetic polynucleotide sequence
gtgtgtgatcaccgcgga

SEQ ID NO: 51811 - DNA, 19 bp, Artificial sequence
  synthetic polynucleotide sequence
cagctgtcgtcactggcaa

SEQ ID NO: 51812 - DNA, 18 bp, Artificial sequence
  synthetic polynucleotide sequence
cgagtgcagctccaccga

SEQ ID NO: 51813 - DNA, 25 bp, Artificial sequence
  synthetic polynucleotide sequence
cagagctccttaggaagaagacaga

SEQ ID NO: 51814 - DNA, 22 bp, Artificial sequence
  synthetic polynucleotide sequence
gtagcccccactctaaacacca

SEQ ID NO: 51815 - DNA, 21 bp, Artificial sequence
  synthetic polynucleotide sequence
ctgacagcgatgatggcgcaa

SEQ ID NO: 51816 - DNA, 20 bp, Artificial sequence
  synthetic polynucleotide sequence
gcaagatgctcccggggaga

SEQ ID NO: 51817 - DNA, 21 bp, Artificial sequence
  synthetic polynucleotide sequence
tccctgccaaatcatccccaa

SEQ ID NO: 51818 - DNA, 25 bp, Artificial sequence
  synthetic polynucleotide sequence
aaggaagaactgatactcgcgagca

SEQ ID NO: 51819 - DNA, 20 bp, Artificial sequence
  synthetic polynucleotide sequence
gggggctggaacacgtacca

SEQ ID NO: 51820 - DNA, 20 bp, Artificial sequence
  synthetic polynucleotide sequence
cttgtggcgaagggctgtca

SEQ ID NO: 51821 - DNA, 20 bp, Artificial sequence
  synthetic polynucleotide sequence
catccgggggcagctctgga

SEQ ID NO: 51822 - DNA, 20 bp, Artificial sequence
  synthetic polynucleotide sequence
ctccaggggtgagctgggga

SEQ ID NO: 51823 - DNA, 20 bp, Artificial sequence
  synthetic polynucleotide sequence
gcagcctgtgcccagctcaa

SEQ ID NO: 51824 - DNA, 20 bp, Artificial sequence
  synthetic polynucleotide sequence
tcctcccagcggaggtggga

SEQ ID NO: 51825 - DNA, 23 bp, Artificial sequence
  synthetic polynucleotide sequence
ctcgaatagctggatcgaggaga

SEQ ID NO: 51826 - DNA, 20 bp, Artificial sequence
  synthetic polynucleotide sequence
cctggcacccctgagtgcca

SEQ ID NO: 51827 - DNA, 25 bp, Artificial sequence
  synthetic polynucleotide sequence
aatagaaccctgagcactggaggaa

SEQ ID NO: 51828 - DNA, 25 bp, Artificial sequence
  synthetic polynucleotide sequence
ccacataggataagaccacagcaca

SEQ ID NO: 51829 - DNA, 21 bp, Artificial sequence
  synthetic polynucleotide sequence
gtccacagtccacggtacaca

SEQ ID NO: 51830 - DNA, 20 bp, Artificial sequence
  synthetic polynucleotide sequence
ctcaggctgggcacgacgaa

SEQ ID NO: 51831 - DNA, 20 bp, Artificial sequence
  synthetic polynucleotide sequence
tctgaacgccggcctgagca

SEQ ID NO: 51832 - DNA, 25 bp, Artificial sequence
  synthetic polynucleotide sequence
caatgaccaggagaatgacgatgca

SEQ ID NO: 51833 - DNA, 21 bp, Artificial sequence
  synthetic polynucleotide sequence
ttataccccctgcaaagccca

SEQ ID NO: 51834 - DNA, 23 bp, Artificial sequence
  synthetic polynucleotide sequence
gggaagtaggataggggacacga

SEQ ID NO: 51835 - DNA, 25 bp, Artificial sequence
  synthetic polynucleotide sequence
gtcacacaaatcagggacagtagga

SEQ ID NO: 51836 - DNA, 23 bp, Artificial sequence
  synthetic polynucleotide sequence
gggcaaggccaatatccggtaca

SEQ ID NO: 51837 - DNA, 25 bp, Artificial sequence
  synthetic polynucleotide sequence
gaccaggtagcaaacactgacagaa

SEQ ID NO: 51838 - DNA, 20 bp, Artificial sequence
  synthetic polynucleotide sequence
cctccgccttccaaagagca

SEQ ID NO: 51839 - DNA, 20 bp, Artificial sequence
  synthetic polynucleotide sequence
gggtggcctaccagtaccca

SEQ ID NO: 51840 - DNA, 21 bp, Artificial sequence
  synthetic polynucleotide sequence
gccgagctcaccgtaagtaca

SEQ ID NO: 51841 - DNA, 21 bp, Artificial sequence
  synthetic polynucleotide sequence
gagctgtccaactaccgagga

SEQ ID NO: 51842 - DNA, 20 bp, Artificial sequence
  synthetic polynucleotide sequence
tcagagagcccactctggca

SEQ ID NO: 51843 - DNA, 20 bp, Artificial sequence
  synthetic polynucleotide sequence
ctcatcgagtcgcggctgga

SEQ ID NO: 51844 - DNA, 20 bp, Artificial sequence
  synthetic polynucleotide sequence
cttgagggtctgcccagtca

SEQ ID NO: 51845 - DNA, 22 bp, Artificial sequence
  synthetic polynucleotide sequence
agctgtggccaataaaggccca

SEQ ID NO: 51846 - DNA, 21 bp, Artificial sequence
  synthetic polynucleotide sequence
ttcaccaaagttgtggcccca

SEQ ID NO: 51847 - DNA, 20 bp, Artificial sequence
  synthetic polynucleotide sequence
cctacacagctggtgcggga

SEQ ID NO: 51848 - DNA, 20 bp, Artificial sequence
  synthetic polynucleotide sequence
gtagcggctccgcagggaga

SEQ ID NO: 51849 - DNA, 23 bp, Artificial sequence
  synthetic polynucleotide sequence
catatccaactcagggaagcgga

SEQ ID NO: 51850 - DNA, 25 bp, Artificial sequence
  synthetic polynucleotide sequence
gacacaggtgaagtgtaaaccagca

SEQ ID NO: 51851 - DNA, 21 bp, Artificial sequence
  synthetic polynucleotide sequence
aaactccaggttggcccacaa

SEQ ID NO: 51852 - DNA, 23 bp, Artificial sequence
  synthetic polynucleotide sequence
caacagcacaaaaagaccaacca

SEQ ID NO: 51853 - DNA, 20 bp, Artificial sequence
  synthetic polynucleotide sequence
agcctggctgagggacaaga

SEQ ID NO: 51854 - DNA, 21 bp, Artificial sequence
  synthetic polynucleotide sequence
ggaagcggggttcaaagagga

SEQ ID NO: 51855 - DNA, 23 bp, Artificial sequence
  synthetic polynucleotide sequence
gggaagagcttagggagtgggaa

SEQ ID NO: 51856 - DNA, 25 bp, Artificial sequence
  synthetic polynucleotide sequence
atacccaatgcaaagggtagggcca

SEQ ID NO: 51857 - DNA, 21 bp, Artificial sequence
  synthetic polynucleotide sequence
ggaactcaaggtggctggaga

SEQ ID NO: 51858 - DNA, 25 bp, Artificial sequence
  synthetic polynucleotide sequence
tacagagcaacttgggcagagagaa

SEQ ID NO: 51859 - DNA, 22 bp, Artificial sequence
  synthetic polynucleotide sequence
aaaacacagcctccgatgccaa

SEQ ID NO: 51860 - DNA, 25 bp, Artificial sequence
  synthetic polynucleotide sequence
catccctatcaggaagacacagaga

SEQ ID NO: 51861 - DNA, 21 bp, Artificial sequence
  synthetic polynucleotide sequence
cgcttgaaccagagagtcgga

SEQ ID NO: 51862 - DNA, 20 bp, Artificial sequence
  synthetic polynucleotide sequence
gctggagtgcagtggcgcga

SEQ ID NO: 51863 - DNA, 20 bp, Artificial sequence
  synthetic polynucleotide sequence
gctctggagaagtgggggaa

SEQ ID NO: 51864 - DNA, 20 bp, Artificial sequence
  synthetic polynucleotide sequence
gcgttccactgacaggagca

SEQ ID NO: 51865 - DNA, 20 bp, Artificial sequence
  synthetic polynucleotide sequence
caccggctaccaaggtacca

SEQ ID NO: 51866 - DNA, 20 bp, Artificial sequence
  synthetic polynucleotide sequence
ccagccacttggaggtgcaa

SEQ ID NO: 51867 - DNA, 23 bp, Artificial sequence
  synthetic polynucleotide sequence
ggggatggaatgggggaagagga

SEQ ID NO: 51868 - DNA, 19 bp, Artificial sequence
  synthetic polynucleotide sequence
gggtgaggccccaacccca

SEQ ID NO: 51869 - DNA, 20 bp, Artificial sequence
  synthetic polynucleotide sequence
caccaccgacctcccgcaga

SEQ ID NO: 51870 - DNA, 20 bp, Artificial sequence
  synthetic polynucleotide sequence
cctgcggaagctggcgtcca

SEQ ID NO: 51871 - DNA, 21 bp, Artificial sequence
  synthetic polynucleotide sequence
tgcaagcatcaaggcagtgga

SEQ ID NO: 51872 - DNA, 22 bp, Artificial sequence
  synthetic polynucleotide sequence
aaggcagaagaaagcccagcaa

SEQ ID NO: 51873 - DNA, 23 bp, Artificial sequence
  synthetic polynucleotide sequence
cctgcccttataggaacagaaga

SEQ ID NO: 51874 - DNA, 23 bp, Artificial sequence
  synthetic polynucleotide sequence
gatgctcaaacacattaggcaca

SEQ ID NO: 51875 - DNA, 20 bp, Artificial sequence
  synthetic polynucleotide sequence
tctcaaccccgcatcgccca

SEQ ID NO: 51876 - DNA, 21 bp, Artificial sequence
  synthetic polynucleotide sequence
ctccttcaggaacagccacca

SEQ ID NO: 51877 - DNA, 20 bp, Artificial sequence
  synthetic polynucleotide sequence
ctgcccacagtgtcgggcaa

SEQ ID NO: 51878 - DNA, 20 bp, Artificial sequence
  synthetic polynucleotide sequence
aagaccgtgccaagtgggga

SEQ ID NO: 51879 - DNA, 20 bp, Artificial sequence
  synthetic polynucleotide sequence
tcaggaaggtcaccggccga

SEQ ID NO: 51880 - DNA, 20 bp, Artificial sequence
  synthetic polynucleotide sequence
caccccactgcacccctgga

SEQ ID NO: 51881 - DNA, 19 bp, Artificial sequence
  synthetic polynucleotide sequence
ccgtcgcgcccggaggaca

SEQ ID NO: 51882 - DNA, 19 bp, Artificial sequence
  synthetic polynucleotide sequence
ggctgacgctgggtgggca

SEQ ID NO: 51883 - DNA, 20 bp, Artificial sequence
  synthetic polynucleotide sequence
ggaaaggcggccaggtgaga

SEQ ID NO: 51884 - DNA, 20 bp, Artificial sequence
  synthetic polynucleotide sequence
tcctctcgggcggagagaga

SEQ ID NO: 51885 - DNA, 22 bp, Artificial sequence
  synthetic polynucleotide sequence
ctctggacttcagccaacagga

SEQ ID NO: 51886 - DNA, 21 bp, Artificial sequence
  synthetic polynucleotide sequence
agctaaggaagccacaaggga

SEQ ID NO: 51887 - DNA, 19 bp, Artificial sequence
  synthetic polynucleotide sequence
cccacccctgtgcccacca

SEQ ID NO: 51888 - DNA, 23 bp, Artificial sequence
  synthetic polynucleotide sequence
gagacagagacggagacatccca

SEQ ID NO: 51889 - DNA, 20 bp, Artificial sequence
  synthetic polynucleotide sequence
ggtggagaaaggaccctgga

SEQ ID NO: 51890 - DNA, 20 bp, Artificial sequence
  synthetic polynucleotide sequence
caacaacccggaggctgcga

SEQ ID NO: 51891 - DNA, 20 bp, Artificial sequence
  synthetic polynucleotide sequence
agcatgcgcgctgtgggcaa

SEQ ID NO: 51892 - DNA, 22 bp, Artificial sequence
  synthetic polynucleotide sequence
cttttcaggcgcagacaacaga

SEQ ID NO: 51893 - DNA, 20 bp, Artificial sequence
  synthetic polynucleotide sequence
cccgcattcagaacctccca

SEQ ID NO: 51894 - DNA, 21 bp, Artificial sequence
  synthetic polynucleotide sequence
ggcatggtgctgggaaaagga

SEQ ID NO: 51895 - DNA, 23 bp, Artificial sequence
  synthetic polynucleotide sequence
ccagttccagaaggctgaagcca

SEQ ID NO: 51896 - DNA, 20 bp, Artificial sequence
  synthetic polynucleotide sequence
catcaggggagtccctccca

SEQ ID NO: 51897 - DNA, 19 bp, Artificial sequence
  synthetic polynucleotide sequence
gaggttggggtggaagaga

SEQ ID NO: 51898 - DNA, 18 bp, Artificial sequence
  synthetic polynucleotide sequence
gacaacctcccaggcaca

SEQ ID NO: 51899 - DNA, 20 bp, Artificial sequence
  synthetic polynucleotide sequence
gctcaccagtccctccccaa

SEQ ID NO: 51900 - DNA, 20 bp, Artificial sequence
  synthetic polynucleotide sequence
ccgacagggccctgtctcca

SEQ ID NO: 51901 - DNA, 21 bp, Artificial sequence
  synthetic polynucleotide sequence
tggaggtaaactgggagagca

SEQ ID NO: 51902 - DNA, 23 bp, Artificial sequence
  synthetic polynucleotide sequence
ggtgctatgggaacatacaacca

SEQ ID NO: 51903 - DNA, 21 bp, Artificial sequence
  synthetic polynucleotide sequence
gcacacttgatgccccagaca

SEQ ID NO: 51904 - DNA, 20 bp, Artificial sequence
  synthetic polynucleotide sequence
tctcccccaggtggagggca

SEQ ID NO: 51905 - DNA, 20 bp, Artificial sequence
  synthetic polynucleotide sequence
ggctggagtgcccagggaga

SEQ ID NO: 51906 - DNA, 20 bp, Artificial sequence
  synthetic polynucleotide sequence
cccaggcagttggctcgaga

SEQ ID NO: 51907 - DNA, 25 bp, Artificial sequence
  synthetic polynucleotide sequence
attctgacgaacaggaccatcagga

SEQ ID NO: 51908 - DNA, 20 bp, Artificial sequence
  synthetic polynucleotide sequence
tgggcctctgagaaggggga

SEQ ID NO: 51909 - DNA, 23 bp, Artificial sequence
  synthetic polynucleotide sequence
ctgcctgctggagagaaaacaca

SEQ ID NO: 51910 - DNA, 21 bp, Artificial sequence
  synthetic polynucleotide sequence
gcagcctcaggtagactagga

SEQ ID NO: 51911 - DNA, 21 bp, Artificial sequence
  synthetic polynucleotide sequence
tccagaaaagctcactgccga

SEQ ID NO: 51912 - DNA, 21 bp, Artificial sequence
  synthetic polynucleotide sequence
tcctcaggacaatggccacaa

SEQ ID NO: 51913 - DNA, 20 bp, Artificial sequence
  synthetic polynucleotide sequence
aggccccccgtgtggacaca

SEQ ID NO: 51914 - DNA, 20 bp, Artificial sequence
  synthetic polynucleotide sequence
gagggggtgagggtgaagca

SEQ ID NO: 51915 - DNA, 20 bp, Artificial sequence
  synthetic polynucleotide sequence
caccttgcaccgtgcaccaa

SEQ ID NO: 51916 - DNA, 23 bp, Artificial sequence
  synthetic polynucleotide sequence
gagccagtcctctgaagagaaca

SEQ ID NO: 51917 - DNA, 20 bp, Artificial sequence
  synthetic polynucleotide sequence
ctgagcatgagctgcagcca

SEQ ID NO: 51918 - DNA, 20 bp, Artificial sequence
  synthetic polynucleotide sequence
tagtggacggagccctggaa

SEQ ID NO: 51919 - DNA, 20 bp, Artificial sequence
  synthetic polynucleotide sequence
cgctggggagaaggtggaca

SEQ ID NO: 51920 - DNA, 20 bp, Artificial sequence
  synthetic polynucleotide sequence
ccttccaagcccagctggca

SEQ ID NO: 51921 - DNA, 20 bp, Artificial sequence
  synthetic polynucleotide sequence
ggcctcagctgtcaccagca

SEQ ID NO: 51922 - DNA, 22 bp, Artificial sequence
  synthetic polynucleotide sequence
ggatcccgaggctaagactcca

SEQ ID NO: 51923 - DNA, 22 bp, Artificial sequence
  synthetic polynucleotide sequence
aaaggggcatcagagaagtgca

SEQ ID NO: 51924 - DNA, 20 bp, Artificial sequence
  synthetic polynucleotide sequence
cgagcagggctgtccggaca

SEQ ID NO: 51925 - DNA, 20 bp, Artificial sequence
  synthetic polynucleotide sequence
gccggctcctgcaagtgcaa

SEQ ID NO: 51926 - DNA, 20 bp, Artificial sequence
  synthetic polynucleotide sequence
ctgggagcagggctctccca

SEQ ID NO: 51927 - DNA, 20 bp, Artificial sequence
  synthetic polynucleotide sequence
gctgcgtctgcaaaggggca

SEQ ID NO: 51928 - DNA, 22 bp, Artificial sequence
  synthetic polynucleotide sequence
tgttcccacatcaggcacagca

SEQ ID NO: 51929 - DNA, 20 bp, Artificial sequence
  synthetic polynucleotide sequence
cacgccttccacctgcccca

SEQ ID NO: 51930 - DNA, 20 bp, Artificial sequence
  synthetic polynucleotide sequence
ggcacacttgctacagccca

SEQ ID NO: 51931 - DNA, 20 bp, Artificial sequence
  synthetic polynucleotide sequence
acctgcgccagctcctgcaa

SEQ ID NO: 51932 - DNA, 20 bp, Artificial sequence
  synthetic polynucleotide sequence
ctgtcccgacatcaggcgca

SEQ ID NO: 51933 - DNA, 21 bp, Artificial sequence
  synthetic polynucleotide sequence
ctgcaaaggggcgtcagagaa

SEQ ID NO: 51934 - DNA, 20 bp, Artificial sequence
  synthetic polynucleotide sequence
tgacagcagggctgtcccga

SEQ ID NO: 51935 - DNA, 20 bp, Artificial sequence
  synthetic polynucleotide sequence
accggctcctgcaagtgcaa

SEQ ID NO: 51936 - DNA, 20 bp, Artificial sequence
  synthetic polynucleotide sequence
tgcagacacagccgtgggca

SEQ ID NO: 51937 - DNA, 22 bp, Artificial sequence
  synthetic polynucleotide sequence
aaagggacgtcagacaagtgca

SEQ ID NO: 51938 - DNA, 20 bp, Artificial sequence
  synthetic polynucleotide sequence
agagcacagctgtcctggca

SEQ ID NO: 51939 - DNA, 20 bp, Artificial sequence
  synthetic polynucleotide sequence
aggggcgtcggacaagtgca

SEQ ID NO: 51940 - DNA, 20 bp, Artificial sequence
  synthetic polynucleotide sequence
ctgggagcggggctgtccca

SEQ ID NO: 51941 - DNA, 22 bp, Artificial sequence
  synthetic polynucleotide sequence
aacaggcccatcaaactccaga

SEQ ID NO: 51942 - DNA, 21 bp, Artificial sequence
  synthetic polynucleotide sequence
ctatagtccctccactgccca

SEQ ID NO: 51943 - DNA, 20 bp, Artificial sequence
  synthetic polynucleotide sequence
ctggtgggtgggcggggaga

SEQ ID NO: 51944 - DNA, 19 bp, Artificial sequence
  synthetic polynucleotide sequence
cctgcctccggtgggcaga

SEQ ID NO: 51945 - DNA, 23 bp, Artificial sequence
  synthetic polynucleotide sequence
caagtagacacactgtgggagga

SEQ ID NO: 51946 - DNA, 20 bp, Artificial sequence
  synthetic polynucleotide sequence
aaaggggcacttcgcctgca

SEQ ID NO: 51947 - DNA, 20 bp, Artificial sequence
  synthetic polynucleotide sequence
cacccactcacccaccccca

SEQ ID NO: 51948 - DNA, 20 bp, Artificial sequence
  synthetic polynucleotide sequence
aggtgaagtcgccgagggga

SEQ ID NO: 51949 - DNA, 20 bp, Artificial sequence
  synthetic polynucleotide sequence
ggggaggaggtggataggaa

SEQ ID NO: 51950 - DNA, 20 bp, Artificial sequence
  synthetic polynucleotide sequence
ctcgtgggcaaggcggtcaa

SEQ ID NO: 51951 - DNA, 19 bp, Artificial sequence
  synthetic polynucleotide sequence
tgcgaacccagtggaagga

SEQ ID NO: 51952 - DNA, 19 bp, Artificial sequence
  synthetic polynucleotide sequence
ccatgccacccgtctccga

SEQ ID NO: 51953 - DNA, 22 bp, Artificial sequence
  synthetic polynucleotide sequence
tgacagagcaggtcaaccagga

SEQ ID NO: 51954 - DNA, 20 bp, Artificial sequence
  synthetic polynucleotide sequence
gactagggcctcaggtcaca

SEQ ID NO: 51955 - DNA, 20 bp, Artificial sequence
  synthetic polynucleotide sequence
tggccctccctcaacaacca

SEQ ID NO: 51956 - DNA, 20 bp, Artificial sequence
  synthetic polynucleotide sequence
ctccacatcgggctccccca

SEQ ID NO: 51957 - DNA, 21 bp, Artificial sequence
  synthetic polynucleotide sequence
aaggcaggagaatggcgtgaa

SEQ ID NO: 51958 - DNA, 20 bp, Artificial sequence
  synthetic polynucleotide sequence
gctggagtgcagtggcacga

SEQ ID NO: 51959 - DNA, 22 bp, Artificial sequence
  synthetic polynucleotide sequence
aagaggacggaatgtggagaca

SEQ ID NO: 51960 - DNA, 20 bp, Artificial sequence
  synthetic polynucleotide sequence
atggcgcgcttcgcccccga

SEQ ID NO: 51961 - DNA, 20 bp, Artificial sequence
  synthetic polynucleotide sequence
gggctgaacatgcctgccaa

SEQ ID NO: 51962 - DNA, 21 bp, Artificial sequence
  synthetic polynucleotide sequence
agaagggcagtctctgaacga

SEQ ID NO: 51963 - DNA, 20 bp, Artificial sequence
  synthetic polynucleotide sequence
gtgggtgatggggaggggca

SEQ ID NO: 51964 - DNA, 21 bp, Artificial sequence
  synthetic polynucleotide sequence
aaaacacagccccagagagga

SEQ ID NO: 51965 - DNA, 20 bp, Artificial sequence
  synthetic polynucleotide sequence
caagcaggaactcaggcgga

SEQ ID NO: 51966 - DNA, 20 bp, Artificial sequence
  synthetic polynucleotide sequence
agagccatgcacagctgcca

SEQ ID NO: 51967 - DNA, 25 bp, Artificial sequence
  synthetic polynucleotide sequence
aggagctagggaaagaaaacctgga

SEQ ID NO: 51968 - DNA, 20 bp, Artificial sequence
  synthetic polynucleotide sequence
cccaaactcccctgccccca

SEQ ID NO: 51969 - DNA, 20 bp, Artificial sequence
  synthetic polynucleotide sequence
atggggaacaggggagggga

SEQ ID NO: 51970 - DNA, 24 bp, Artificial sequence
  synthetic polynucleotide sequence
aacttaatcccaaaagccctgcca

SEQ ID NO: 51971 - DNA, 23 bp, Artificial sequence
  synthetic polynucleotide sequence
gcaaactctaacccaccagcaca

SEQ ID NO: 51972 - DNA, 21 bp, Artificial sequence
  synthetic polynucleotide sequence
ggctgagttacgagcagagca

SEQ ID NO: 51973 - DNA, 23 bp, Artificial sequence
  synthetic polynucleotide sequence
gttgaggagagctgtgatgacca

SEQ ID NO: 51974 - DNA, 20 bp, Artificial sequence
  synthetic polynucleotide sequence
ctcagcacagtgtccgggaa

SEQ ID NO: 51975 - DNA, 20 bp, Artificial sequence
  synthetic polynucleotide sequence
gctctccagctggcccccaa

SEQ ID NO: 51976 - DNA, 22 bp, Artificial sequence
  synthetic polynucleotide sequence
ggatctgagggagatccaggga

SEQ ID NO: 51977 - DNA, 20 bp, Artificial sequence
  synthetic polynucleotide sequence
cacctgtgcggcacctggaa

SEQ ID NO: 51978 - DNA, 20 bp, Artificial sequence
  synthetic polynucleotide sequence
caccacccacacagcagcca

SEQ ID NO: 51979 - DNA, 22 bp, Artificial sequence
  synthetic polynucleotide sequence
tcaggagcaaccagtcagtgaa

SEQ ID NO: 51980 - DNA, 25 bp, Artificial sequence
  synthetic polynucleotide sequence
agtcaatgaaagagtaagggggcca

SEQ ID NO: 51981 - DNA, 22 bp, Artificial sequence
  synthetic polynucleotide sequence
ctggaagcgcatgcacactgaa

SEQ ID NO: 51982 - DNA, 21 bp, Artificial sequence
  synthetic polynucleotide sequence
ttagggctgaaaccctgagga

SEQ ID NO: 51983 - DNA, 18 bp, Artificial sequence
  synthetic polynucleotide sequence
cccagcatgtgttccgca

SEQ ID NO: 51984 - DNA, 20 bp, Artificial sequence
  synthetic polynucleotide sequence
ccgtccacgtcgtagaggga

SEQ ID NO: 51985 - DNA, 20 bp, Artificial sequence
  synthetic polynucleotide sequence
cccaggtccccatcacgcca

SEQ ID NO: 51986 - DNA, 20 bp, Artificial sequence
  synthetic polynucleotide sequence
tcacggcaccagcatgtgca

SEQ ID NO: 51987 - DNA, 18 bp, Artificial sequence
  synthetic polynucleotide sequence
cttcatccgcgcacggaa

SEQ ID NO: 51988 - DNA, 18 bp, Artificial sequence
  synthetic polynucleotide sequence
agcatgaccactcggcca

SEQ ID NO: 51989 - DNA, 20 bp, Artificial sequence
  synthetic polynucleotide sequence
cgaaccatccgctacccaga

SEQ ID NO: 51990 - DNA, 20 bp, Artificial sequence
  synthetic polynucleotide sequence
cacgaccgaggttggctcca

SEQ ID NO: 51991 - DNA, 20 bp, Artificial sequence
  synthetic polynucleotide sequence
gagactgagcggtgcatcga

SEQ ID NO: 51992 - DNA, 21 bp, Artificial sequence
  synthetic polynucleotide sequence
atcatgcggtcaaggacacca

SEQ ID NO: 51993 - DNA, 20 bp, Artificial sequence
  synthetic polynucleotide sequence
gagcctgagccttgggaaca

SEQ ID NO: 51994 - DNA, 20 bp, Artificial sequence
  synthetic polynucleotide sequence
ggacagggggaactctcaga

SEQ ID NO: 51995 - DNA, 25 bp, Artificial sequence
  synthetic polynucleotide sequence
ccagaaggaaaatggcctaactgga

SEQ ID NO: 51996 - DNA, 23 bp, Artificial sequence
  synthetic polynucleotide sequence
catactgattccccaaacgcgaa

SEQ ID NO: 51997 - DNA, 22 bp, Artificial sequence
  synthetic polynucleotide sequence
tacaacagtggaaagttgggga

SEQ ID NO: 51998 - DNA, 23 bp, Artificial sequence
  synthetic polynucleotide sequence
gattggggaaagtagatcggaca

SEQ ID NO: 51999 - DNA, 20 bp, Artificial sequence
  synthetic polynucleotide sequence
tgcaacggaagccaggccaa

SEQ ID NO: 52000 - DNA, 22 bp, Artificial sequence
  synthetic polynucleotide sequence
tgccaaacattcccccaaagga

SEQ ID NO: 52001 - DNA, 20 bp, Artificial sequence
  synthetic polynucleotide sequence
ccccagcagtgtcgctccaa

SEQ ID NO: 52002 - DNA, 22 bp, Artificial sequence
  synthetic polynucleotide sequence
gttaccttggccaagcaccgaa

SEQ ID NO: 52003 - DNA, 21 bp, Artificial sequence
  synthetic polynucleotide sequence
tggaagtgcgcctggtcgaga

SEQ ID NO: 52004 - DNA, 18 bp, Artificial sequence
  synthetic polynucleotide sequence
cagcgactcctcccccga

SEQ ID NO: 52005 - DNA, 20 bp, Artificial sequence
  synthetic polynucleotide sequence
agggtccaagggaggaagga

SEQ ID NO: 52006 - DNA, 20 bp, Artificial sequence
  synthetic polynucleotide sequence
cctaactggcctcccaggga

SEQ ID NO: 52007 - DNA, 23 bp, Artificial sequence
  synthetic polynucleotide sequence
gcacacacacacaccaagtacca

SEQ ID NO: 52008 - DNA, 21 bp, Artificial sequence
  synthetic polynucleotide sequence
caacggaatcggatgagggga

SEQ ID NO: 52009 - DNA, 22 bp, Artificial sequence
  synthetic polynucleotide sequence
ttgcactagacatgacgaggga

SEQ ID NO: 52010 - DNA, 20 bp, Artificial sequence
  synthetic polynucleotide sequence
gcgtctccccactcagaaca

SEQ ID NO: 52011 - DNA, 21 bp, Artificial sequence
  synthetic polynucleotide sequence
gaccacgcctaaatagccgca

SEQ ID NO: 52012 - DNA, 20 bp, Artificial sequence
  synthetic polynucleotide sequence
ctcgagcgccgcgagaagga

SEQ ID NO: 52013 - DNA, 20 bp, Artificial sequence
  synthetic polynucleotide sequence
gaggccccaggtgtcactga

SEQ ID NO: 52014 - DNA, 21 bp, Artificial sequence
  synthetic polynucleotide sequence
ttctccttgctgcaacaggga

SEQ ID NO: 52015 - DNA, 22 bp, Artificial sequence
  synthetic polynucleotide sequence
agaagcggcctaggacagaaca

SEQ ID NO: 52016 - DNA, 20 bp, Artificial sequence
  synthetic polynucleotide sequence
ggtcccaggtgtacagcaca

SEQ ID NO: 52017 - DNA, 19 bp, Artificial sequence
  synthetic polynucleotide sequence
cagctgcccagggtgggga

SEQ ID NO: 52018 - DNA, 20 bp, Artificial sequence
  synthetic polynucleotide sequence
tgggcacaactgcaagcgga

SEQ ID NO: 52019 - DNA, 20 bp, Artificial sequence
  synthetic polynucleotide sequence
gaggaggagggcgaggacga

SEQ ID NO: 52020 - DNA, 25 bp, Artificial sequence
  synthetic polynucleotide sequence
ctaacagaggcaaaactgagcacca

SEQ ID NO: 52021 - DNA, 20 bp, Artificial sequence
  synthetic polynucleotide sequence
gatggcggccgttaaggaca

SEQ ID NO: 52022 - DNA, 20 bp, Artificial sequence
  synthetic polynucleotide sequence
ccacaaacacggcctcagga

SEQ ID NO: 52023 - DNA, 23 bp, Artificial sequence
  synthetic polynucleotide sequence
cccgtcggaaaccggaaaaagca

SEQ ID NO: 52024 - DNA, 19 bp, Artificial sequence
  synthetic polynucleotide sequence
ggctcgtgggaggcccgaa

SEQ ID NO: 52025 - DNA, 20 bp, Artificial sequence
  synthetic polynucleotide sequence
gtgaggatggcactccccga

SEQ ID NO: 52026 - DNA, 22 bp, Artificial sequence
  synthetic polynucleotide sequence
tgagcagggttgggaaaacaca

SEQ ID NO: 52027 - DNA, 20 bp, Artificial sequence
  synthetic polynucleotide sequence
atcagaggtgacaggcccca

SEQ ID NO: 52028 - DNA, 20 bp, Artificial sequence
  synthetic polynucleotide sequence
gggacaccgaatggcaggga

SEQ ID NO: 52029 - DNA, 20 bp, Artificial sequence
  synthetic polynucleotide sequence
actcctcagctgccccccaa

SEQ ID NO: 52030 - DNA, 20 bp, Artificial sequence
  synthetic polynucleotide sequence
accaccacccagagcaggaa

SEQ ID NO: 52031 - DNA, 25 bp, Artificial sequence
  synthetic polynucleotide sequence
gcacacctcacagaacatcagagaa

SEQ ID NO: 52032 - DNA, 20 bp, Artificial sequence
  synthetic polynucleotide sequence
cccccaaggagcttgatcca

SEQ ID NO: 52033 - DNA, 23 bp, Artificial sequence
  synthetic polynucleotide sequence
ccaagaggaggacagagaaagga

SEQ ID NO: 52034 - DNA, 25 bp, Artificial sequence
  synthetic polynucleotide sequence
cagctgaaagaggaacttcccacaa

SEQ ID NO: 52035 - DNA, 19 bp, Artificial sequence
  synthetic polynucleotide sequence
ccctggacatcagggagca

SEQ ID NO: 52036 - DNA, 18 bp, Artificial sequence
  synthetic polynucleotide sequence
cttgctctcgcctgagca

SEQ ID NO: 52037 - DNA, 20 bp, Artificial sequence
  synthetic polynucleotide sequence
ccaccagcgaccctcctcaa

SEQ ID NO: 52038 - DNA, 20 bp, Artificial sequence
  synthetic polynucleotide sequence
gagatcccaatggccccaca

SEQ ID NO: 52039 - DNA, 21 bp, Artificial sequence
  synthetic polynucleotide sequence
acagagagggtaacaggagga

SEQ ID NO: 52040 - DNA, 20 bp, Artificial sequence
  synthetic polynucleotide sequence
tctcccaccccatcccccca

SEQ ID NO: 52041 - DNA, 20 bp, Artificial sequence
  synthetic polynucleotide sequence
gtctctgaggggagcggcga

SEQ ID NO: 52042 - DNA, 19 bp, Artificial sequence
  synthetic polynucleotide sequence
cccgccggagtcaggccca

SEQ ID NO: 52043 - DNA, 20 bp, Artificial sequence
  synthetic polynucleotide sequence
tgggtgggagggctgggaca

SEQ ID NO: 52044 - DNA, 23 bp, Artificial sequence
  synthetic polynucleotide sequence
gaaggttggaaactaaaggggga

SEQ ID NO: 52045 - DNA, 25 bp, Artificial sequence
  synthetic polynucleotide sequence
atccgcaacgatgaggagctcaaca

SEQ ID NO: 52046 - DNA, 20 bp, Artificial sequence
  synthetic polynucleotide sequence
tggcagcagcacggcctgga

SEQ ID NO: 52047 - DNA, 22 bp, Artificial sequence
  synthetic polynucleotide sequence
agctcaacaagctgctgggcaa

SEQ ID NO: 52048 - DNA, 20 bp, Artificial sequence
  synthetic polynucleotide sequence
gggcagtagcacagcctgga

SEQ ID NO: 52049 - DNA, 20 bp, Artificial sequence
  synthetic polynucleotide sequence
caacgcagcccgcgacaaca

SEQ ID NO: 52050 - DNA, 20 bp, Artificial sequence
  synthetic polynucleotide sequence
cagctgcaagtggcgcggga

SEQ ID NO: 52051 - DNA, 21 bp, Artificial sequence
  synthetic polynucleotide sequence
tgctccctaagaagacggaga

SEQ ID NO: 52052 - DNA, 20 bp, Artificial sequence
  synthetic polynucleotide sequence
ctgggcccacttgggccgga

SEQ ID NO: 52053 - DNA, 21 bp, Artificial sequence
  synthetic polynucleotide sequence
cgcactacaacaagcgctcga

SEQ ID NO: 52054 - DNA, 19 bp, Artificial sequence
  synthetic polynucleotide sequence
cttggccagctcccccgga

SEQ ID NO: 52055 - DNA, 22 bp, Artificial sequence
  synthetic polynucleotide sequence
aaggccgtcaccaagtatacca

SEQ ID NO: 52056 - DNA, 19 bp, Artificial sequence
  synthetic polynucleotide sequence
gggtgtgggtcacggcgga

SEQ ID NO: 52057 - DNA, 20 bp, Artificial sequence
  synthetic polynucleotide sequence
gctgtgtcagagggcaccaa

SEQ ID NO: 52058 - DNA, 21 bp, Artificial sequence
  synthetic polynucleotide sequence
actaaggcagttgcagggaca

SEQ ID NO: 52059 - DNA, 20 bp, Artificial sequence
  synthetic polynucleotide sequence
cctccagggagatccagaca

SEQ ID NO: 52060 - DNA, 20 bp, Artificial sequence
  synthetic polynucleotide sequence
ggacacggcgtgcttggcca

SEQ ID NO: 52061 - DNA, 20 bp, Artificial sequence
  synthetic polynucleotide sequence
cacctccagggagatccaga

SEQ ID NO: 52062 - DNA, 20 bp, Artificial sequence
  synthetic polynucleotide sequence
cttggccagctccccgggca

SEQ ID NO: 52063 - DNA, 20 bp, Artificial sequence
  synthetic polynucleotide sequence
ctgtgcgccatccacgccaa

SEQ ID NO: 52064 - DNA, 20 bp, Artificial sequence
  synthetic polynucleotide sequence
ccctctcgccgcggatacga

SEQ ID NO: 52065 - DNA, 19 bp, Artificial sequence
  synthetic polynucleotide sequence
ggcgctaagcgccaccgta

SEQ ID NO: 52066 - DNA, 20 bp, Artificial sequence
  synthetic polynucleotide sequence
tcctcgtagatgaggccgga

SEQ ID NO: 52067 - DNA, 20 bp, Artificial sequence
  synthetic polynucleotide sequence
gactgacagacacgctggga

SEQ ID NO: 52068 - DNA, 20 bp, Artificial sequence
  synthetic polynucleotide sequence
tggccgacgcccacacacca

SEQ ID NO: 52069 - DNA, 20 bp, Artificial sequence
  synthetic polynucleotide sequence
tccactgggggcatccagaa

SEQ ID NO: 52070 - DNA, 25 bp, Artificial sequence
  synthetic polynucleotide sequence
tgtcccatagaagagagacaccaca

SEQ ID NO: 52071 - DNA, 18 bp, Artificial sequence
  synthetic polynucleotide sequence
cgctcctgccccacccca

SEQ ID NO: 52072 - DNA, 22 bp, Artificial sequence
  synthetic polynucleotide sequence
cacagtccgcgatgaaatgaca

SEQ ID NO: 52073 - DNA, 21 bp, Artificial sequence
  synthetic polynucleotide sequence
accgcaaaaacgagggctaca

SEQ ID NO: 52074 - DNA, 20 bp, Artificial sequence
  synthetic polynucleotide sequence
caggcgggaaacagagtgga

SEQ ID NO: 52075 - DNA, 20 bp, Artificial sequence
  synthetic polynucleotide sequence
cgctcacacccggctcgaga

SEQ ID NO: 52076 - DNA, 18 bp, Artificial sequence
  synthetic polynucleotide sequence
cgccccccaccttccgca

SEQ ID NO: 52077 - DNA, 20 bp, Artificial sequence
  synthetic polynucleotide sequence
atcctggaactggcgggcaa

SEQ ID NO: 52078 - DNA, 20 bp, Artificial sequence
  synthetic polynucleotide sequence
cagttggagatgacgcggga

SEQ ID NO: 52079 - DNA, 20 bp, Artificial sequence
  synthetic polynucleotide sequence
cacctccagggagatccaga

SEQ ID NO: 52080 - DNA, 20 bp, Artificial sequence
  synthetic polynucleotide sequence
cttggccaactccccaggca

SEQ ID NO: 52081 - DNA, 20 bp, Artificial sequence
  synthetic polynucleotide sequence
atgtgagcccagccctgcca

SEQ ID NO: 52082 - DNA, 20 bp, Artificial sequence
  synthetic polynucleotide sequence
ggaggcccttaggagaccaa

SEQ ID NO: 52083 - DNA, 20 bp, Artificial sequence
  synthetic polynucleotide sequence
caggccctgtagggacagca

SEQ ID NO: 52084 - DNA, 22 bp, Artificial sequence
  synthetic polynucleotide sequence
tcccatgagtgagtacaggcca

SEQ ID NO: 52085 - DNA, 20 bp, Artificial sequence
  synthetic polynucleotide sequence
agcatcagccccaatgccca

SEQ ID NO: 52086 - DNA, 23 bp, Artificial sequence
  synthetic polynucleotide sequence
cagcatggagaaggcagaaacca

SEQ ID NO: 52087 - DNA, 20 bp, Artificial sequence
  synthetic polynucleotide sequence
ggccaccgtgccccacaaga

SEQ ID NO: 52088 - DNA, 20 bp, Artificial sequence
  synthetic polynucleotide sequence
tccaacctgggactgggcca

SEQ ID NO: 52089 - DNA, 20 bp, Artificial sequence
  synthetic polynucleotide sequence
tggggagatgagcagcccaa

SEQ ID NO: 52090 - DNA, 19 bp, Artificial sequence
  synthetic polynucleotide sequence
ttgctgggctgagctccca

SEQ ID NO: 52091 - DNA, 20 bp, Artificial sequence
  synthetic polynucleotide sequence
ctccacgatccagcctagga

SEQ ID NO: 52092 - DNA, 22 bp, Artificial sequence
  synthetic polynucleotide sequence
aaagctgaggaactgctccaga

SEQ ID NO: 52093 - DNA, 25 bp, Artificial sequence
  synthetic polynucleotide sequence
accccctagaagcctagaaatggga

SEQ ID NO: 52094 - DNA, 21 bp, Artificial sequence
  synthetic polynucleotide sequence
ttgccactcctccagagagaa

SEQ ID NO: 52095 - DNA, 20 bp, Artificial sequence
  synthetic polynucleotide sequence
cctgtcaccgaagccaggaa

SEQ ID NO: 52096 - DNA, 25 bp, Artificial sequence
  synthetic polynucleotide sequence
aaagaacgccactggaggatgtaca

SEQ ID NO: 52097 - DNA, 20 bp, Artificial sequence
  synthetic polynucleotide sequence
gaaggtcacctgagcctgga

SEQ ID NO: 52098 - DNA, 20 bp, Artificial sequence
  synthetic polynucleotide sequence
gtgagagtggaccatcccca

SEQ ID NO: 52099 - DNA, 21 bp, Artificial sequence
  synthetic polynucleotide sequence
tgctggagcagttcctgacca

SEQ ID NO: 52100 - DNA, 22 bp, Artificial sequence
  synthetic polynucleotide sequence
aaatcctccagcacagtcacca

SEQ ID NO: 52101 - DNA, 20 bp, Artificial sequence
  synthetic polynucleotide sequence
gagctgtgcatcccccacaa

SEQ ID NO: 52102 - DNA, 23 bp, Artificial sequence
  synthetic polynucleotide sequence
ggtacagtgaggggtgaatggaa

SEQ ID NO: 52103 - DNA, 20 bp, Artificial sequence
  synthetic polynucleotide sequence
agcctgtctccaccgcccga

SEQ ID NO: 52104 - DNA, 22 bp, Artificial sequence
  synthetic polynucleotide sequence
agcgctaggtgtacagaaagga

SEQ ID NO: 52105 - DNA, 20 bp, Artificial sequence
  synthetic polynucleotide sequence
catctgaaaccccctccgca

SEQ ID NO: 52106 - DNA, 23 bp, Artificial sequence
  synthetic polynucleotide sequence
ccaattgaatggggcagacagaa

SEQ ID NO: 52107 - DNA, 20 bp, Artificial sequence
  synthetic polynucleotide sequence
ccagtccctgtgacggggca

SEQ ID NO: 52108 - DNA, 20 bp, Artificial sequence
  synthetic polynucleotide sequence
tcgtggcagtcgaccccaga

SEQ ID NO: 52109 - DNA, 21 bp, Artificial sequence
  synthetic polynucleotide sequence
cagatctggcatcagaggcca

SEQ ID NO: 52110 - DNA, 22 bp, Artificial sequence
  synthetic polynucleotide sequence
taaaggccgacacagaggtgaa

SEQ ID NO: 52111 - DNA, 20 bp, Artificial sequence
  synthetic polynucleotide sequence
gacgactgcctggagtccaa

SEQ ID NO: 52112 - DNA, 20 bp, Artificial sequence
  synthetic polynucleotide sequence
gctaaccactggtggccaca

SEQ ID NO: 52113 - DNA, 20 bp, Artificial sequence
  synthetic polynucleotide sequence
cgagggccaattcaacccca

SEQ ID NO: 52114 - DNA, 23 bp, Artificial sequence
  synthetic polynucleotide sequence
caccagtcagagctccacagaga

SEQ ID NO: 52115 - DNA, 20 bp, Artificial sequence
  synthetic polynucleotide sequence
cgcgacacccgtgtgctcaa

SEQ ID NO: 52116 - DNA, 20 bp, Artificial sequence
  synthetic polynucleotide sequence
ggcctggcacacatagcaga

SEQ ID NO: 52117 - DNA, 20 bp, Artificial sequence
  synthetic polynucleotide sequence
cgtcaccatcggtgccacca

SEQ ID NO: 52118 - DNA, 18 bp, Artificial sequence
  synthetic polynucleotide sequence
ttcctggccctgcgccga

SEQ ID NO: 52119 - DNA, 20 bp, Artificial sequence
  synthetic polynucleotide sequence
ctcccctcagcccctgccga

SEQ ID NO: 52120 - DNA, 20 bp, Artificial sequence
  synthetic polynucleotide sequence
gtgaggcagggaagcgggga

SEQ ID NO: 52121 - DNA, 20 bp, Artificial sequence
  synthetic polynucleotide sequence
tgttggggaggggagaccga

SEQ ID NO: 52122 - DNA, 20 bp, Artificial sequence
  synthetic polynucleotide sequence
tcgcgctcagctgcacaaca

SEQ ID NO: 52123 - DNA, 20 bp, Artificial sequence
  synthetic polynucleotide sequence
ccaagacctccagccctgga

SEQ ID NO: 52124 - DNA, 20 bp, Artificial sequence
  synthetic polynucleotide sequence
cccctgaggtggcaagagaa

SEQ ID NO: 52125 - DNA, 25 bp, Artificial sequence
  synthetic polynucleotide sequence
gacacagaaatgggagaggttacca

SEQ ID NO: 52126 - DNA, 20 bp, Artificial sequence
  synthetic polynucleotide sequence
aggcccaaactcctcaccca

SEQ ID NO: 52127 - DNA, 22 bp, Artificial sequence
  synthetic polynucleotide sequence
gattacggcatcagaaagggca

SEQ ID NO: 52128 - DNA, 20 bp, Artificial sequence
  synthetic polynucleotide sequence
ctgccaacaccccatgccca

SEQ ID NO: 52129 - DNA, 21 bp, Artificial sequence
  synthetic polynucleotide sequence
aacctgtaatcggcaacccca

SEQ ID NO: 52130 - DNA, 23 bp, Artificial sequence
  synthetic polynucleotide sequence
gatatagagggggagatgtggaa

SEQ ID NO: 52131 - DNA, 22 bp, Artificial sequence
  synthetic polynucleotide sequence
ctcgacctcgtagatgagaaca

SEQ ID NO: 52132 - DNA, 20 bp, Artificial sequence
  synthetic polynucleotide sequence
catatgccccgcggtgacaa

SEQ ID NO: 52133 - DNA, 20 bp, Artificial sequence
  synthetic polynucleotide sequence
aggcctcccgcaagctgcca

SEQ ID NO: 52134 - DNA, 23 bp, Artificial sequence
  synthetic polynucleotide sequence
gaagggaagagaaaggccacaca

SEQ ID NO: 52135 - DNA, 19 bp, Artificial sequence
  synthetic polynucleotide sequence
ccggactcggctcctggca

SEQ ID NO: 52136 - DNA, 25 bp, Artificial sequence
  synthetic polynucleotide sequence
gaagccatacagaattgcacggcga

SEQ ID NO: 52137 - DNA, 21 bp, Artificial sequence
  synthetic polynucleotide sequence
caggagcgaaccatgatgcca

SEQ ID NO: 52138 - DNA, 20 bp, Artificial sequence
  synthetic polynucleotide sequence
tcgacgtgcagcggtcagca

SEQ ID NO: 52139 - DNA, 19 bp, Artificial sequence
  synthetic polynucleotide sequence
ctcagccctcccccaccca

SEQ ID NO: 52140 - DNA, 25 bp, Artificial sequence
  synthetic polynucleotide sequence
gtaggggatcagacatgaaaggcca

SEQ ID NO: 52141 - DNA, 18 bp, Artificial sequence
  synthetic polynucleotide sequence
aggcgaaccagcagctga

SEQ ID NO: 52142 - DNA, 18 bp, Artificial sequence
  synthetic polynucleotide sequence
atcaggacacccacccca

SEQ ID NO: 52143 - DNA, 20 bp, Artificial sequence
  synthetic polynucleotide sequence
cgccacaaaggagccaagca

SEQ ID NO: 52144 - DNA, 22 bp, Artificial sequence
  synthetic polynucleotide sequence
gttgtcacacagaccagcaaga

SEQ ID NO: 52145 - DNA, 22 bp, Artificial sequence
  synthetic polynucleotide sequence
tcacccccaaaagaacctccca

SEQ ID NO: 52146 - DNA, 25 bp, Artificial sequence
  synthetic polynucleotide sequence
gaacagggaaacccatagagacaga

SEQ ID NO: 52147 - DNA, 22 bp, Artificial sequence
  synthetic polynucleotide sequence
gcaatgcactgcatccccccaa

SEQ ID NO: 52148 - DNA, 25 bp, Artificial sequence
  synthetic polynucleotide sequence
tgcgaaacagtggataagagaggga

SEQ ID NO: 52149 - DNA, 20 bp, Artificial sequence
  synthetic polynucleotide sequence
gaggaaaggccctagggaga

SEQ ID NO: 52150 - DNA, 21 bp, Artificial sequence
  synthetic polynucleotide sequence
tgacagtcccaacactctgca

SEQ ID NO: 52151 - DNA, 22 bp, Artificial sequence
  synthetic polynucleotide sequence
cagacacccagtggaaggtcaa

SEQ ID NO: 52152 - DNA, 25 bp, Artificial sequence
  synthetic polynucleotide sequence
actgaaccgggaggaaaacagtgaa

SEQ ID NO: 52153 - DNA, 20 bp, Artificial sequence
  synthetic polynucleotide sequence
agggaggctcagctctgcca

SEQ ID NO: 52154 - DNA, 22 bp, Artificial sequence
  synthetic polynucleotide sequence
gtctggccctgaagaaagagaa

SEQ ID NO: 52155 - DNA, 21 bp, Artificial sequence
  synthetic polynucleotide sequence
tgtcacaaccttccggaagga

SEQ ID NO: 52156 - DNA, 22 bp, Artificial sequence
  synthetic polynucleotide sequence
atcccagaaatgatcctggaca

SEQ ID NO: 52157 - DNA, 21 bp, Artificial sequence
  synthetic polynucleotide sequence
aaggaacaagcctcagtccca

SEQ ID NO: 52158 - DNA, 22 bp, Artificial sequence
  synthetic polynucleotide sequence
acagcagggagagctgagaaca

SEQ ID NO: 52159 - DNA, 18 bp, Artificial sequence
  synthetic polynucleotide sequence
cccacccccacccctgca

SEQ ID NO: 52160 - DNA, 25 bp, Artificial sequence
  synthetic polynucleotide sequence
aatctagaaagccgagggtgtgaca

SEQ ID NO: 52161 - DNA, 20 bp, Artificial sequence
  synthetic polynucleotide sequence
cccccgggacttacactgca

SEQ ID NO: 52162 - DNA, 20 bp, Artificial sequence
  synthetic polynucleotide sequence
tccgacagccgacgaaagca

SEQ ID NO: 52163 - DNA, 25 bp, Artificial sequence
  synthetic polynucleotide sequence
aaaggcataaaccagacctgtccca

SEQ ID NO: 52164 - DNA, 23 bp, Artificial sequence
  synthetic polynucleotide sequence
cacctagatcagggtacccacaa

SEQ ID NO: 52165 - DNA, 25 bp, Artificial sequence
  synthetic polynucleotide sequence
gtgagctaaggaaagatggagccaa

SEQ ID NO: 52166 - DNA, 22 bp, Artificial sequence
  synthetic polynucleotide sequence
gactggcagaaagagcatcgca

SEQ ID NO: 52167 - DNA, 20 bp, Artificial sequence
  synthetic polynucleotide sequence
caccagctgctggggtggga

SEQ ID NO: 52168 - DNA, 20 bp, Artificial sequence
  synthetic polynucleotide sequence
ggcccacgtggtgaacgaga

SEQ ID NO: 52169 - DNA, 20 bp, Artificial sequence
  synthetic polynucleotide sequence
aggagggctcccgagtggaa

SEQ ID NO: 52170 - DNA, 21 bp, Artificial sequence
  synthetic polynucleotide sequence
ccccatctcgaagggacacaa

SEQ ID NO: 52171 - DNA, 21 bp, Artificial sequence
  synthetic polynucleotide sequence
accaacctgaacgactacgga

SEQ ID NO: 52172 - DNA, 21 bp, Artificial sequence
  synthetic polynucleotide sequence
tcccagtaacagctgtcgaga

SEQ ID NO: 52173 - DNA, 21 bp, Artificial sequence
  synthetic polynucleotide sequence
agggaaatggctaaggtggca

SEQ ID NO: 52174 - DNA, 20 bp, Artificial sequence
  synthetic polynucleotide sequence
acaggagtccctcagggcaa

SEQ ID NO: 52175 - DNA, 20 bp, Artificial sequence
  synthetic polynucleotide sequence
aacgaggctggcacctggca

SEQ ID NO: 52176 - DNA, 24 bp, Artificial sequence
  synthetic polynucleotide sequence
cacttatgcaggaagatgaaggga

SEQ ID NO: 52177 - DNA, 20 bp, Artificial sequence
  synthetic polynucleotide sequence
ctgggacccaactggccaca

SEQ ID NO: 52178 - DNA, 22 bp, Artificial sequence
  synthetic polynucleotide sequence
ggtaggtgggtctaaaccagga

SEQ ID NO: 52179 - DNA, 20 bp, Artificial sequence
  synthetic polynucleotide sequence
ccaacctggactccactcca

SEQ ID NO: 52180 - DNA, 25 bp, Artificial sequence
  synthetic polynucleotide sequence
tcacagcagtgctacaaggaaagca

SEQ ID NO: 52181 - DNA, 20 bp, Artificial sequence
  synthetic polynucleotide sequence
ccagtggaaacctgtgcgca

SEQ ID NO: 52182 - DNA, 25 bp, Artificial sequence
  synthetic polynucleotide sequence
gagcaggtatagaagctcagagaca

SEQ ID NO: 52183 - DNA, 20 bp, Artificial sequence
  synthetic polynucleotide sequence
gtgggaggtcaagtggggaa

SEQ ID NO: 52184 - DNA, 23 bp, Artificial sequence
  synthetic polynucleotide sequence
catgtcaggaaagctgcaacaca

SEQ ID NO: 52185 - DNA, 20 bp, Artificial sequence
  synthetic polynucleotide sequence
ctgtggagaccagagggcca

SEQ ID NO: 52186 - DNA, 22 bp, Artificial sequence
  synthetic polynucleotide sequence
agggagaagaagaggtgctgga

SEQ ID NO: 52187 - DNA, 25 bp, Artificial sequence
  synthetic polynucleotide sequence
aaggacagtgatgaggaagatggca

SEQ ID NO: 52188 - DNA, 20 bp, Artificial sequence
  synthetic polynucleotide sequence
gtcacaggccgccatgagga

SEQ ID NO: 52189 - DNA, 20 bp, Artificial sequence
  synthetic polynucleotide sequence
gggagcctgaggactctgga

SEQ ID NO: 52190 - DNA, 20 bp, Artificial sequence
  synthetic polynucleotide sequence
cttgggcctaaggagcccga

SEQ ID NO: 52191 - DNA, 20 bp, Artificial sequence
  synthetic polynucleotide sequence
ccttccacctgaggggagca

SEQ ID NO: 52192 - DNA, 20 bp, Artificial sequence
  synthetic polynucleotide sequence
tgacagccagccaccccaga

SEQ ID NO: 52193 - DNA, 21 bp, Artificial sequence
  synthetic polynucleotide sequence
gacagtagcgctgagtcagca

SEQ ID NO: 52194 - DNA, 25 bp, Artificial sequence
  synthetic polynucleotide sequence
gctgacacaaaatgagactccgaca

SEQ ID NO: 52195 - DNA, 20 bp, Artificial sequence
  synthetic polynucleotide sequence
tggccccagagtgactccga

SEQ ID NO: 52196 - DNA, 20 bp, Artificial sequence
  synthetic polynucleotide sequence
cgccggctcatctccggaga

SEQ ID NO: 52197 - DNA, 22 bp, Artificial sequence
  synthetic polynucleotide sequence
ttgcaatcagtgtaaccacgga

SEQ ID NO: 52198 - DNA, 21 bp, Artificial sequence
  synthetic polynucleotide sequence
aatagccggatgcacagtcca

SEQ ID NO: 52199 - DNA, 20 bp, Artificial sequence
  synthetic polynucleotide sequence
tccactgagggcaggtccaa

SEQ ID NO: 52200 - DNA, 23 bp, Artificial sequence
  synthetic polynucleotide sequence
ggtacatgaatgctgcagaccca

SEQ ID NO: 52201 - DNA, 20 bp, Artificial sequence
  synthetic polynucleotide sequence
ccagagggtgagcttcacca

SEQ ID NO: 52202 - DNA, 21 bp, Artificial sequence
  synthetic polynucleotide sequence
tagacagtgatgatgggccca

SEQ ID NO: 52203 - DNA, 21 bp, Artificial sequence
  synthetic polynucleotide sequence
acccgcaaaaaggcagacgaa

SEQ ID NO: 52204 - DNA, 21 bp, Artificial sequence
  synthetic polynucleotide sequence
gcagcaatgcctggaaagcga

SEQ ID NO: 52205 - DNA, 20 bp, Artificial sequence
  synthetic polynucleotide sequence
ctccacacggcaggggcaga

SEQ ID NO: 52206 - DNA, 21 bp, Artificial sequence
  synthetic polynucleotide sequence
caggatggagtggagtgcaga

SEQ ID NO: 52207 - DNA, 20 bp, Artificial sequence
  synthetic polynucleotide sequence
ccgagtgtgtagacggccaa

SEQ ID NO: 52208 - DNA, 20 bp, Artificial sequence
  synthetic polynucleotide sequence
caagcaccccgctggtgaga

SEQ ID NO: 52209 - DNA, 20 bp, Artificial sequence
  synthetic polynucleotide sequence
caagcggaaggccctgtcca

SEQ ID NO: 52210 - DNA, 20 bp, Artificial sequence
  synthetic polynucleotide sequence
ggctggtggatgggcgggaa

SEQ ID NO: 52211 - DNA, 20 bp, Artificial sequence
  synthetic polynucleotide sequence
aggagccagtcatgccggaa

SEQ ID NO: 52212 - DNA, 20 bp, Artificial sequence
  synthetic polynucleotide sequence
gttgcctccaacagcaggga

SEQ ID NO: 52213 - DNA, 19 bp, Artificial sequence
  synthetic polynucleotide sequence
ctctgcagcctggtgccca

SEQ ID NO: 52214 - DNA, 21 bp, Artificial sequence
  synthetic polynucleotide sequence
tgatctgctccatcaccagga

SEQ ID NO: 52215 - DNA, 19 bp, Artificial sequence
  synthetic polynucleotide sequence
ggggagggacctggtggga

SEQ ID NO: 52216 - DNA, 19 bp, Artificial sequence
  synthetic polynucleotide sequence
ggcgggggaggcctcagga

SEQ ID NO: 52217 - DNA, 20 bp, Artificial sequence
  synthetic polynucleotide sequence
agcgtcccagcaggacagca

SEQ ID NO: 52218 - DNA, 22 bp, Artificial sequence
  synthetic polynucleotide sequence
gaagctgcagcgaggttacaga

SEQ ID NO: 52219 - DNA, 20 bp, Artificial sequence
  synthetic polynucleotide sequence
acagcagctcacgtgacgga

SEQ ID NO: 52220 - DNA, 22 bp, Artificial sequence
  synthetic polynucleotide sequence
atcacgaccacttgagtagaga

SEQ ID NO: 52221 - DNA, 20 bp, Artificial sequence
  synthetic polynucleotide sequence
cgtagggcacaccaggtcca

SEQ ID NO: 52222 - DNA, 22 bp, Artificial sequence
  synthetic polynucleotide sequence
ggtggagaagcacatgaccaca

SEQ ID NO: 52223 - DNA, 22 bp, Artificial sequence
  synthetic polynucleotide sequence
atgtggtcatgaacaggcgtga

SEQ ID NO: 52224 - DNA, 21 bp, Artificial sequence
  synthetic polynucleotide sequence
gacacacactgaggtcaggga

SEQ ID NO: 52225 - DNA, 20 bp, Artificial sequence
  synthetic polynucleotide sequence
gggagtgctggcctgacaca

SEQ ID NO: 52226 - DNA, 21 bp, Artificial sequence
  synthetic polynucleotide sequence
acatgagaaggcaggtgtcca

SEQ ID NO: 52227 - DNA, 20 bp, Artificial sequence
  synthetic polynucleotide sequence
cactgccccagctactccaa

SEQ ID NO: 52228 - DNA, 22 bp, Artificial sequence
  synthetic polynucleotide sequence
atcagggcagaaaagcacagaa

SEQ ID NO: 52229 - DNA, 21 bp, Artificial sequence
  synthetic polynucleotide sequence
gaccccactgaagctgagcaa

SEQ ID NO: 52230 - DNA, 25 bp, Artificial sequence
  synthetic polynucleotide sequence
tccagggagagtaagagatcagcaa

SEQ ID NO: 52231 - DNA, 20 bp, Artificial sequence
  synthetic polynucleotide sequence
ccatctctagacccccccaa

SEQ ID NO: 52232 - DNA, 20 bp, Artificial sequence
  synthetic polynucleotide sequence
cacgcccgcagcggtgcaga

SEQ ID NO: 52233 - DNA, 21 bp, Artificial sequence
  synthetic polynucleotide sequence
cagtagagaccccagcacaga

SEQ ID NO: 52234 - DNA, 21 bp, Artificial sequence
  synthetic polynucleotide sequence
gagtgacccaaggggtagaga

SEQ ID NO: 52235 - DNA, 21 bp, Artificial sequence
  synthetic polynucleotide sequence
gaagccagctagatctgggga

SEQ ID NO: 52236 - DNA, 25 bp, Artificial sequence
  synthetic polynucleotide sequence
gtggtgaggaaagaagtgatcggaa

SEQ ID NO: 52237 - DNA, 21 bp, Artificial sequence
  synthetic polynucleotide sequence
ctcgaaccagcgctaacagca

SEQ ID NO: 52238 - DNA, 21 bp, Artificial sequence
  synthetic polynucleotide sequence
tctctggctgtggaaagacca

SEQ ID NO: 52239 - DNA, 22 bp, Artificial sequence
  synthetic polynucleotide sequence
aaggcaaaccttatgacccaca

SEQ ID NO: 52240 - DNA, 21 bp, Artificial sequence
  synthetic polynucleotide sequence
ccccgatcctaggaacgtaca

SEQ ID NO: 52241 - DNA, 20 bp, Artificial sequence
  synthetic polynucleotide sequence
cttccaagggagcgctggga

SEQ ID NO: 52242 - DNA, 21 bp, Artificial sequence
  synthetic polynucleotide sequence
ttcaaagatccctgaggcgga

SEQ ID NO: 52243 - DNA, 21 bp, Artificial sequence
  synthetic polynucleotide sequence
gaaggctgggtgaagtgacca

SEQ ID NO: 52244 - DNA, 25 bp, Artificial sequence
  synthetic polynucleotide sequence
aaaaggcaaagaggaggtaagccca

SEQ ID NO: 52245 - DNA, 20 bp, Artificial sequence
  synthetic polynucleotide sequence
gcagggacaggggctgaaca

SEQ ID NO: 52246 - DNA, 22 bp, Artificial sequence
  synthetic polynucleotide sequence
gagaaggaaaccagagctggga

SEQ ID NO: 52247 - DNA, 18 bp, Artificial sequence
  synthetic polynucleotide sequence
cgcagcaccggtcagcaa

SEQ ID NO: 52248 - DNA, 20 bp, Artificial sequence
  synthetic polynucleotide sequence
gtggatggactggaagggga

SEQ ID NO: 52249 - DNA, 20 bp, Artificial sequence
  synthetic polynucleotide sequence
tgaagccttccagccagcca

SEQ ID NO: 52250 - DNA, 20 bp, Artificial sequence
  synthetic polynucleotide sequence
cagggtgggaggtgatccaa

SEQ ID NO: 52251 - DNA, 20 bp, Artificial sequence
  synthetic polynucleotide sequence
ctggaactgggagacaggga

SEQ ID NO: 52252 - DNA, 20 bp, Artificial sequence
  synthetic polynucleotide sequence
cactaacacgggccgaggga

SEQ ID NO: 52253 - DNA, 20 bp, Artificial sequence
  synthetic polynucleotide sequence
ctcaacgcctaccagagcaa

SEQ ID NO: 52254 - DNA, 19 bp, Artificial sequence
  synthetic polynucleotide sequence
tccttctgaagggcagcca

SEQ ID NO: 52255 - DNA, 22 bp, Artificial sequence
  synthetic polynucleotide sequence
gccaaccagcagacattaccca

SEQ ID NO: 52256 - DNA, 23 bp, Artificial sequence
  synthetic polynucleotide sequence
ccagggaatgctaggtaaaggca

SEQ ID NO: 52257 - DNA, 21 bp, Artificial sequence
  synthetic polynucleotide sequence
aaatggaaccagggcctgaca

SEQ ID NO: 52258 - DNA, 21 bp, Artificial sequence
  synthetic polynucleotide sequence
gtatcacctgagggggaagga

SEQ ID NO: 52259 - DNA, 19 bp, Artificial sequence
  synthetic polynucleotide sequence
gtgtccgggagctacggga

SEQ ID NO: 52260 - DNA, 18 bp, Artificial sequence
  synthetic polynucleotide sequence
tgaggcgctcccccagca

SEQ ID NO: 52261 - DNA, 20 bp, Artificial sequence
  synthetic polynucleotide sequence
cctgtctccgagagcaccga

SEQ ID NO: 52262 - DNA, 20 bp, Artificial sequence
  synthetic polynucleotide sequence
caagcaccccgctggtgaga

SEQ ID NO: 52263 - DNA, 22 bp, Artificial sequence
  synthetic polynucleotide sequence
gtcaggagagcgagatggaaga

SEQ ID NO: 52264 - DNA, 20 bp, Artificial sequence
  synthetic polynucleotide sequence
caagcaccccgctggtgaga

SEQ ID NO: 52265 - DNA, 19 bp, Artificial sequence
  synthetic polynucleotide sequence
ggactggggccagcacgga

SEQ ID NO: 52266 - DNA, 20 bp, Artificial sequence
  synthetic polynucleotide sequence
ccagagaatggcagcgagga

SEQ ID NO: 52267 - DNA, 20 bp, Artificial sequence
  synthetic polynucleotide sequence
gccatcatggctgaccccga

SEQ ID NO: 52268 - DNA, 20 bp, Artificial sequence
  synthetic polynucleotide sequence
cggatgtgcacggtggcgga

SEQ ID NO: 52269 - DNA, 23 bp, Artificial sequence
  synthetic polynucleotide sequence
cctgaacaccaaggctcaagaga

SEQ ID NO: 52270 - DNA, 22 bp, Artificial sequence
  synthetic polynucleotide sequence
gtgcagggtgaaaatcaggaga

SEQ ID NO: 52271 - DNA, 22 bp, Artificial sequence
  synthetic polynucleotide sequence
tcccctcactgagagaatgaca

SEQ ID NO: 52272 - DNA, 25 bp, Artificial sequence
  synthetic polynucleotide sequence
tgacacaaagagcacagacctcaca

SEQ ID NO: 52273 - DNA, 19 bp, Artificial sequence
  synthetic polynucleotide sequence
cgctggggacaccgctgca

SEQ ID NO: 52274 - DNA, 20 bp, Artificial sequence
  synthetic polynucleotide sequence
ctgtggcgaaggagggtcaa

SEQ ID NO: 52275 - DNA, 20 bp, Artificial sequence
  synthetic polynucleotide sequence
gaggcctcagggatggagga

SEQ ID NO: 52276 - DNA, 21 bp, Artificial sequence
  synthetic polynucleotide sequence
tcctctagccctgaggcctca

SEQ ID NO: 52277 - DNA, 20 bp, Artificial sequence
  synthetic polynucleotide sequence
ccaagggaggtccccacaga

SEQ ID NO: 52278 - DNA, 20 bp, Artificial sequence
  synthetic polynucleotide sequence
tgtccaagatccagggggca

SEQ ID NO: 52279 - DNA, 21 bp, Artificial sequence
  synthetic polynucleotide sequence
ttgaaggctgagacaggagga

SEQ ID NO: 52280 - DNA, 22 bp, Artificial sequence
  synthetic polynucleotide sequence
caggctatagcataagggcaca

SEQ ID NO: 52281 - DNA, 18 bp, Artificial sequence
  synthetic polynucleotide sequence
cgccccgctcggcatgca

SEQ ID NO: 52282 - DNA, 19 bp, Artificial sequence
  synthetic polynucleotide sequence
gcgccccgtaggtctgcga

SEQ ID NO: 52283 - DNA, 22 bp, Artificial sequence
  synthetic polynucleotide sequence
aaccaagcaaacaccacaacca

SEQ ID NO: 52284 - DNA, 23 bp, Artificial sequence
  synthetic polynucleotide sequence
ctgaagaagacgctggtgtcaca

SEQ ID NO: 52285 - DNA, 20 bp, Artificial sequence
  synthetic polynucleotide sequence
ggcgtctcccgcagtgacca

SEQ ID NO: 52286 - DNA, 20 bp, Artificial sequence
  synthetic polynucleotide sequence
tctggccagcaggatcccca

SEQ ID NO: 52287 - DNA, 20 bp, Artificial sequence
  synthetic polynucleotide sequence
tcccatggagcccgagagaa

SEQ ID NO: 52288 - DNA, 18 bp, Artificial sequence
  synthetic polynucleotide sequence
gtgcctcggccgctggca

SEQ ID NO: 52289 - DNA, 20 bp, Artificial sequence
  synthetic polynucleotide sequence
cctctggacgccgcagtgca

SEQ ID NO: 52290 - DNA, 20 bp, Artificial sequence
  synthetic polynucleotide sequence
gctggagggtgccaagggca

SEQ ID NO: 52291 - DNA, 20 bp, Artificial sequence
  synthetic polynucleotide sequence
cacaggaacagcttccccca

SEQ ID NO: 52292 - DNA, 20 bp, Artificial sequence
  synthetic polynucleotide sequence
aggggtctgaagaggcggca

SEQ ID NO: 52293 - DNA, 20 bp, Artificial sequence
  synthetic polynucleotide sequence
ccatcgtccaggatcaggga

SEQ ID NO: 52294 - DNA, 20 bp, Artificial sequence
  synthetic polynucleotide sequence
aagcggagtggacgactgga

SEQ ID NO: 52295 - DNA, 20 bp, Artificial sequence
  synthetic polynucleotide sequence
aagggacggacctggtggga

SEQ ID NO: 52296 - DNA, 20 bp, Artificial sequence
  synthetic polynucleotide sequence
tcctggtggaaggggaagca

SEQ ID NO: 52297 - DNA, 20 bp, Artificial sequence
  synthetic polynucleotide sequence
gcccacctgacccctgccaa

SEQ ID NO: 52298 - DNA, 18 bp, Artificial sequence
  synthetic polynucleotide sequence
gcatgggctgggccccga

SEQ ID NO: 52299 - DNA, 20 bp, Artificial sequence
  synthetic polynucleotide sequence
tcctccaagctccagagcca

SEQ ID NO: 52300 - DNA, 20 bp, Artificial sequence
  synthetic polynucleotide sequence
tgcctcaaccggccaaggaa

SEQ ID NO: 52301 - DNA, 20 bp, Artificial sequence
  synthetic polynucleotide sequence
caacaccaggtgcttgggga

SEQ ID NO: 52302 - DNA, 21 bp, Artificial sequence
  synthetic polynucleotide sequence
cccagcactgagtcaggtgaa

SEQ ID NO: 52303 - DNA, 22 bp, Artificial sequence
  synthetic polynucleotide sequence
aggacctataggcacgtgaaga

SEQ ID NO: 52304 - DNA, 23 bp, Artificial sequence
  synthetic polynucleotide sequence
gaataggaatagagccatgccca

SEQ ID NO: 52305 - DNA, 20 bp, Artificial sequence
  synthetic polynucleotide sequence
gtgcccgtcagtgagaagca

SEQ ID NO: 52306 - DNA, 25 bp, Artificial sequence
  synthetic polynucleotide sequence
acacagcagcatggaatggacaaga

SEQ ID NO: 52307 - DNA, 23 bp, Artificial sequence
  synthetic polynucleotide sequence
gaagatgacctaaggaacccaga

SEQ ID NO: 52308 - DNA, 20 bp, Artificial sequence
  synthetic polynucleotide sequence
ggccccagaccaagtcgcca

SEQ ID NO: 52309 - DNA, 25 bp, Artificial sequence
  synthetic polynucleotide sequence
cagggaagtggaagaaaatcgccca

SEQ ID NO: 52310 - DNA, 22 bp, Artificial sequence
  synthetic polynucleotide sequence
ctcccttaagggaacctcgcaa

SEQ ID NO: 52311 - DNA, 21 bp, Artificial sequence
  synthetic polynucleotide sequence
agtggatgcggactcaggcta

SEQ ID NO: 52312 - DNA, 20 bp, Artificial sequence
  synthetic polynucleotide sequence
tgtccgctctccaccaacga

SEQ ID NO: 52313 - DNA, 18 bp, Artificial sequence
  synthetic polynucleotide sequence
tcctgccctggacacaga

SEQ ID NO: 52314 - DNA, 20 bp, Artificial sequence
  synthetic polynucleotide sequence
cacaggaggcagtgtcagca

SEQ ID NO: 52315 - DNA, 20 bp, Artificial sequence
  synthetic polynucleotide sequence
ccggaagatccccacatcga

SEQ ID NO: 52316 - DNA, 20 bp, Artificial sequence
  synthetic polynucleotide sequence
gactcgtagcgacgtggaca

SEQ ID NO: 52317 - DNA, 20 bp, Artificial sequence
  synthetic polynucleotide sequence
ggccctcaggatcctcggca

SEQ ID NO: 52318 - DNA, 20 bp, Artificial sequence
  synthetic polynucleotide sequence
atgaccgtacaggtggccga

SEQ ID NO: 52319 - DNA, 22 bp, Artificial sequence
  synthetic polynucleotide sequence
catatctggagggcccatgaca

SEQ ID NO: 52320 - DNA, 21 bp, Artificial sequence
  synthetic polynucleotide sequence
tccccagagaaggcctgtcca

SEQ ID NO: 52321 - DNA, 23 bp, Artificial sequence
  synthetic polynucleotide sequence
gcaacacgaagcttccagaacca

SEQ ID NO: 52322 - DNA, 23 bp, Artificial sequence
  synthetic polynucleotide sequence
cacaacagccatggaatcaggca

SEQ ID NO: 52323 - DNA, 20 bp, Artificial sequence
  synthetic polynucleotide sequence
ggaatggggtgggcatggga

SEQ ID NO: 52324 - DNA, 25 bp, Artificial sequence
  synthetic polynucleotide sequence
ctgggcacgtggaaaaaggtcagaa

SEQ ID NO: 52325 - DNA, 22 bp, Artificial sequence
  synthetic polynucleotide sequence
tgggtaatatggcaagagccca

SEQ ID NO: 52326 - DNA, 20 bp, Artificial sequence
  synthetic polynucleotide sequence
tgcctcccaggctcaaacga

SEQ ID NO: 52327 - DNA, 21 bp, Artificial sequence
  synthetic polynucleotide sequence
ctgcctctaagccagacctga

SEQ ID NO: 52328 - DNA, 19 bp, Artificial sequence
  synthetic polynucleotide sequence
tggccaaaggtctcgggca

SEQ ID NO: 52329 - DNA, 21 bp, Artificial sequence
  synthetic polynucleotide sequence
taccatgttgagggcacagga

SEQ ID NO: 52330 - DNA, 20 bp, Artificial sequence
  synthetic polynucleotide sequence
ggagacccaggccactccca

SEQ ID NO: 52331 - DNA, 21 bp, Artificial sequence
  synthetic polynucleotide sequence
cagacaccccagcaactacca

SEQ ID NO: 52332 - DNA, 20 bp, Artificial sequence
  synthetic polynucleotide sequence
tgggactgggcctgccacca

SEQ ID NO: 52333 - DNA, 21 bp, Artificial sequence
  synthetic polynucleotide sequence
tcaggaggaggaggatgacga

SEQ ID NO: 52334 - DNA, 21 bp, Artificial sequence
  synthetic polynucleotide sequence
tcggacagtagcatcccctga

SEQ ID NO: 52335 - DNA, 22 bp, Artificial sequence
  synthetic polynucleotide sequence
tgaagcttaggactaccagcca

SEQ ID NO: 52336 - DNA, 20 bp, Artificial sequence
  synthetic polynucleotide sequence
ggtgatccacccacctccca

SEQ ID NO: 52337 - DNA, 21 bp, Artificial sequence
  synthetic polynucleotide sequence
gagccgagaatccacagtcca

SEQ ID NO: 52338 - DNA, 20 bp, Artificial sequence
  synthetic polynucleotide sequence
tcgaaagcgggggtcgcgga

SEQ ID NO: 52339 - DNA, 20 bp, Artificial sequence
  synthetic polynucleotide sequence
ctgctgagggaggaggcgaa

SEQ ID NO: 52340 - DNA, 20 bp, Artificial sequence
  synthetic polynucleotide sequence
ccctcggcgatcccgaacga

SEQ ID NO: 52341 - DNA, 19 bp, Artificial sequence
  synthetic polynucleotide sequence
gctgccccctcactgccca

SEQ ID NO: 52342 - DNA, 19 bp, Artificial sequence
  synthetic polynucleotide sequence
gccacgcatccagccgcca

SEQ ID NO: 52343 - DNA, 20 bp, Artificial sequence
  synthetic polynucleotide sequence
ctgtgccagaaccctcccca

SEQ ID NO: 52344 - DNA, 20 bp, Artificial sequence
  synthetic polynucleotide sequence
aagtcagccgctccccacaa

SEQ ID NO: 52345 - DNA, 20 bp, Artificial sequence
  synthetic polynucleotide sequence
ctccagcacaaaggggcgca

SEQ ID NO: 52346 - DNA, 20 bp, Artificial sequence
  synthetic polynucleotide sequence
tctcacttcgggcctccaca

SEQ ID NO: 52347 - DNA, 20 bp, Artificial sequence
  synthetic polynucleotide sequence
ccaggtgcttcccagggcca

SEQ ID NO: 52348 - DNA, 20 bp, Artificial sequence
  synthetic polynucleotide sequence
ctcggtgagacgacgctgga

SEQ ID NO: 52349 - DNA, 20 bp, Artificial sequence
  synthetic polynucleotide sequence
ctggacagacctgctggaga

SEQ ID NO: 52350 - DNA, 25 bp, Artificial sequence
  synthetic polynucleotide sequence
caagtaaaaacctgctggacccaca

SEQ ID NO: 52351 - DNA, 21 bp, Artificial sequence
  synthetic polynucleotide sequence
acacagtcaccgtgaccacca

SEQ ID NO: 52352 - DNA, 20 bp, Artificial sequence
  synthetic polynucleotide sequence
gagagcagggggtctctgga

SEQ ID NO: 52353 - DNA, 20 bp, Artificial sequence
  synthetic polynucleotide sequence
gagcccgaaggcggaacaga

SEQ ID NO: 52354 - DNA, 21 bp, Artificial sequence
  synthetic polynucleotide sequence
aggagagagccgataagacca

SEQ ID NO: 52355 - DNA, 23 bp, Artificial sequence
  synthetic polynucleotide sequence
gcccactcagtgaacgagagaca

SEQ ID NO: 52356 - DNA, 20 bp, Artificial sequence
  synthetic polynucleotide sequence
ccagcccaggaattcccaga

SEQ ID NO: 52357 - DNA, 21 bp, Artificial sequence
  synthetic polynucleotide sequence
ataagatcagggcgggtcaga

SEQ ID NO: 52358 - DNA, 21 bp, Artificial sequence
  synthetic polynucleotide sequence
tatctgtgagccccaagagga

SEQ ID NO: 52359 - DNA, 20 bp, Artificial sequence
  synthetic polynucleotide sequence
tcagcagatgggcgccgcaa

SEQ ID NO: 52360 - DNA, 20 bp, Artificial sequence
  synthetic polynucleotide sequence
gacagctaccaccccatcca

SEQ ID NO: 52361 - DNA, 22 bp, Artificial sequence
  synthetic polynucleotide sequence
atatgcaagcccctacactaca

SEQ ID NO: 52362 - DNA, 22 bp, Artificial sequence
  synthetic polynucleotide sequence
gtaagtgcacggcaaacgccaa

SEQ ID NO: 52363 - DNA, 21 bp, Artificial sequence
  synthetic polynucleotide sequence
agcctgggcaacaaaacgaga

SEQ ID NO: 52364 - DNA, 23 bp, Artificial sequence
  synthetic polynucleotide sequence
gttgccaaaacaaagctgaagca

SEQ ID NO: 52365 - DNA, 20 bp, Artificial sequence
  synthetic polynucleotide sequence
cagatccctatgggcagcca

SEQ ID NO: 52366 - DNA, 23 bp, Artificial sequence
  synthetic polynucleotide sequence
ggggagatggagcaatacagcca

SEQ ID NO: 52367 - DNA, 18 bp, Artificial sequence
  synthetic polynucleotide sequence
cccagcgccaggggacca

SEQ ID NO: 52368 - DNA, 20 bp, Artificial sequence
  synthetic polynucleotide sequence
gagacggacacacactggga

SEQ ID NO: 52369 - DNA, 21 bp, Artificial sequence
  synthetic polynucleotide sequence
aatctccagcacacggtgaga

SEQ ID NO: 52370 - DNA, 22 bp, Artificial sequence
  synthetic polynucleotide sequence
gaaggcctcaaacaagggcaga

SEQ ID NO: 52371 - DNA, 20 bp, Artificial sequence
  synthetic polynucleotide sequence
gccaagagggcgtttgggca

SEQ ID NO: 52372 - DNA, 20 bp, Artificial sequence
  synthetic polynucleotide sequence
cccccactccacactatcca

SEQ ID NO: 52373 - DNA, 22 bp, Artificial sequence
  synthetic polynucleotide sequence
ttctacccacagaaggttggca

SEQ ID NO: 52374 - DNA, 23 bp, Artificial sequence
  synthetic polynucleotide sequence
ccagagttaagaaccagcaccca

SEQ ID NO: 52375 - DNA, 23 bp, Artificial sequence
  synthetic polynucleotide sequence
ctgctgcggaagaatcagaggaa

SEQ ID NO: 52376 - DNA, 23 bp, Artificial sequence
  synthetic polynucleotide sequence
caattgcaagggtgaagcaggca

SEQ ID NO: 52377 - DNA, 20 bp, Artificial sequence
  synthetic polynucleotide sequence
gcggtggtaacggtcgcgga

SEQ ID NO: 52378 - DNA, 20 bp, Artificial sequence
  synthetic polynucleotide sequence
actcagtcgccggcctccca

SEQ ID NO: 52379 - DNA, 20 bp, Artificial sequence
  synthetic polynucleotide sequence
tgtgtgacccagggccacga

SEQ ID NO: 52380 - DNA, 22 bp, Artificial sequence
  synthetic polynucleotide sequence
gtgcttgaaggcatacccaaca

SEQ ID NO: 52381 - DNA, 20 bp, Artificial sequence
  synthetic polynucleotide sequence
gaggcgaaaggctgtggcca

SEQ ID NO: 52382 - DNA, 23 bp, Artificial sequence
  synthetic polynucleotide sequence
gtgaggatggtgtagaaggcaga

SEQ ID NO: 52383 - DNA, 22 bp, Artificial sequence
  synthetic polynucleotide sequence
ggaagaagaaagcgctggccca

SEQ ID NO: 52384 - DNA, 25 bp, Artificial sequence
  synthetic polynucleotide sequence
caaggggtaagaaatggcacatgga

SEQ ID NO: 52385 - DNA, 19 bp, Artificial sequence
  synthetic polynucleotide sequence
ctacccggggcccttccca

SEQ ID NO: 52386 - DNA, 20 bp, Artificial sequence
  synthetic polynucleotide sequence
gcttcaggagggcggctcca

SEQ ID NO: 52387 - DNA, 20 bp, Artificial sequence
  synthetic polynucleotide sequence
tgacgtgggcaatcgcacca

SEQ ID NO: 52388 - DNA, 20 bp, Artificial sequence
  synthetic polynucleotide sequence
gtcatggcggttgcggagga

SEQ ID NO: 52389 - DNA, 20 bp, Artificial sequence
  synthetic polynucleotide sequence
gcgggccttcggcagatgca

SEQ ID NO: 52390 - DNA, 23 bp, Artificial sequence
  synthetic polynucleotide sequence
catagccaacgatcccaccagaa

SEQ ID NO: 52391 - DNA, 20 bp, Artificial sequence
  synthetic polynucleotide sequence
cccgcccactgtcagcagca

SEQ ID NO: 52392 - DNA, 20 bp, Artificial sequence
  synthetic polynucleotide sequence
acagtgcctggaggacagca

SEQ ID NO: 52393 - DNA, 20 bp, Artificial sequence
  synthetic polynucleotide sequence
ctgggacagctgcagcacga

SEQ ID NO: 52394 - DNA, 20 bp, Artificial sequence
  synthetic polynucleotide sequence
cacctcgcagctctcacgca

SEQ ID NO: 52395 - DNA, 25 bp, Artificial sequence
  synthetic polynucleotide sequence
cttctcagaagcaaggagtggacaa

SEQ ID NO: 52396 - DNA, 20 bp, Artificial sequence
  synthetic polynucleotide sequence
accccaaaagagggacccca

SEQ ID NO: 52397 - DNA, 25 bp, Artificial sequence
  synthetic polynucleotide sequence
acaaccacagctcagaattccagca

SEQ ID NO: 52398 - DNA, 21 bp, Artificial sequence
  synthetic polynucleotide sequence
caccttcaaggcaccagtcca

SEQ ID NO: 52399 - DNA, 23 bp, Artificial sequence
  synthetic polynucleotide sequence
gtcccagactgagggaaggtgaa

SEQ ID NO: 52400 - DNA, 20 bp, Artificial sequence
  synthetic polynucleotide sequence
atcacacccagggcaggaca

SEQ ID NO: 52401 - DNA, 19 bp, Artificial sequence
  synthetic polynucleotide sequence
ccccctgacccccgctcca

SEQ ID NO: 52402 - DNA, 20 bp, Artificial sequence
  synthetic polynucleotide sequence
gtgggggctaggatggagca

SEQ ID NO: 52403 - DNA, 23 bp, Artificial sequence
  synthetic polynucleotide sequence
gaaaagcagaagatggagtagga

SEQ ID NO: 52404 - DNA, 23 bp, Artificial sequence
  synthetic polynucleotide sequence
caaggcacaaatcacacaaacca

SEQ ID NO: 52405 - DNA, 20 bp, Artificial sequence
  synthetic polynucleotide sequence
cccagactaggggtcaggca

SEQ ID NO: 52406 - DNA, 22 bp, Artificial sequence
  synthetic polynucleotide sequence
aagtagaagaggtggtggccaa

SEQ ID NO: 52407 - DNA, 20 bp, Artificial sequence
  synthetic polynucleotide sequence
aagggcccaggaaaacccca

SEQ ID NO: 52408 - DNA, 20 bp, Artificial sequence
  synthetic polynucleotide sequence
gtcaggcacaagcactgcca

SEQ ID NO: 52409 - DNA, 22 bp, Artificial sequence
  synthetic polynucleotide sequence
aagctggaagctgcagaagaca

SEQ ID NO: 52410 - DNA, 20 bp, Artificial sequence
  synthetic polynucleotide sequence
gctggggcctcactagggca

SEQ ID NO: 52411 - DNA, 21 bp, Artificial sequence
  synthetic polynucleotide sequence
gacctggccaaggtacagaga

SEQ ID NO: 52412 - DNA, 23 bp, Artificial sequence
  synthetic polynucleotide sequence
ccacgtaccagtgaacaaaggca

SEQ ID NO: 52413 - DNA, 20 bp, Artificial sequence
  synthetic polynucleotide sequence
gacgagtccacccaggggaa

SEQ ID NO: 52414 - DNA, 22 bp, Artificial sequence
  synthetic polynucleotide sequence
ttgaagaccaggtattcccgga

SEQ ID NO: 52415 - DNA, 20 bp, Artificial sequence
  synthetic polynucleotide sequence
acagcggaggcctgcaggaa

SEQ ID NO: 52416 - DNA, 22 bp, Artificial sequence
  synthetic polynucleotide sequence
ccagaaagcaatgcctcggcca

SEQ ID NO: 52417 - DNA, 23 bp, Artificial sequence
  synthetic polynucleotide sequence
ccatgtagaaggaagccaggaga

SEQ ID NO: 52418 - DNA, 20 bp, Artificial sequence
  synthetic polynucleotide sequence
gaggacgctgccgtgtccaa

SEQ ID NO: 52419 - DNA, 20 bp, Artificial sequence
  synthetic polynucleotide sequence
gccaatctctggagccgaca

SEQ ID NO: 52420 - DNA, 25 bp, Artificial sequence
  synthetic polynucleotide sequence
caagcgccaaaagtactgggtggaa

SEQ ID NO: 52421 - DNA, 20 bp, Artificial sequence
  synthetic polynucleotide sequence
caactggccatccgcaacga

SEQ ID NO: 52422 - DNA, 20 bp, Artificial sequence
  synthetic polynucleotide sequence
caagacaccaccctgcgcga

SEQ ID NO: 52423 - DNA, 21 bp, Artificial sequence
  synthetic polynucleotide sequence
tctacttgagggagggcagaa

SEQ ID NO: 52424 - DNA, 25 bp, Artificial sequence
  synthetic polynucleotide sequence
attgagaacacacgaagctggcaca

SEQ ID NO: 52425 - DNA, 20 bp, Artificial sequence
  synthetic polynucleotide sequence
aacagggccgtgggtctgga

SEQ ID NO: 52426 - DNA, 23 bp, Artificial sequence
  synthetic polynucleotide sequence
ccccaggcaatacaacagctcca

SEQ ID NO: 52427 - DNA, 19 bp, Artificial sequence
  synthetic polynucleotide sequence
ggcgaggtggccgaggcaa

SEQ ID NO: 52428 - DNA, 25 bp, Artificial sequence
  synthetic polynucleotide sequence
agtagacaccccaggcaatacaaca

SEQ ID NO: 52429 - DNA, 19 bp, Artificial sequence
  synthetic polynucleotide sequence
gggtgaggtggccgaggca

SEQ ID NO: 52430 - DNA, 25 bp, Artificial sequence
  synthetic polynucleotide sequence
agtagacaccccaggcaatacaaca

SEQ ID NO: 52431 - DNA, 21 bp, Artificial sequence
  synthetic polynucleotide sequence
ttggagcatcaaagtgggcca

SEQ ID NO: 52432 - DNA, 23 bp, Artificial sequence
  synthetic polynucleotide sequence
cccaggcaatacaacagctccga

SEQ ID NO: 52433 - DNA, 20 bp, Artificial sequence
  synthetic polynucleotide sequence
tagagcctgggacctggcca

SEQ ID NO: 52434 - DNA, 19 bp, Artificial sequence
  synthetic polynucleotide sequence
gcttgcggggtccagggca

SEQ ID NO: 52435 - DNA, 19 bp, Artificial sequence
  synthetic polynucleotide sequence
ccaaaacccgggccaggca

SEQ ID NO: 52436 - DNA, 19 bp, Artificial sequence
  synthetic polynucleotide sequence
ccagggtgctggctgagga

SEQ ID NO: 52437 - DNA, 22 bp, Artificial sequence
  synthetic polynucleotide sequence
ttgccaaaccagagattggaga

SEQ ID NO: 52438 - DNA, 22 bp, Artificial sequence
  synthetic polynucleotide sequence
aaaggtttcagagggagcagga

SEQ ID NO: 52439 - DNA, 23 bp, Artificial sequence
  synthetic polynucleotide sequence
gcagaaaagaagggcgtgtacca

SEQ ID NO: 52440 - DNA, 22 bp, Artificial sequence
  synthetic polynucleotide sequence
tccagtgatggagtagcacaga

SEQ ID NO: 52441 - DNA, 20 bp, Artificial sequence
  synthetic polynucleotide sequence
cagtgagggactgggagaga

SEQ ID NO: 52442 - DNA, 22 bp, Artificial sequence
  synthetic polynucleotide sequence
atcaaggtgtcagtgaacacca

SEQ ID NO: 52443 - DNA, 18 bp, Artificial sequence
  synthetic polynucleotide sequence
gagcagagccagcgccga

SEQ ID NO: 52444 - DNA, 18 bp, Artificial sequence
  synthetic polynucleotide sequence
cggctggcacaggctgca

SEQ ID NO: 52445 - DNA, 22 bp, Artificial sequence
  synthetic polynucleotide sequence
gacagcagaacgacttgacaca

SEQ ID NO: 52446 - DNA, 20 bp, Artificial sequence
  synthetic polynucleotide sequence
catgccaggccacaacccaa

SEQ ID NO: 52447 - DNA, 25 bp, Artificial sequence
  synthetic polynucleotide sequence
ggagccaaagattgtgagaggacga

SEQ ID NO: 52448 - DNA, 22 bp, Artificial sequence
  synthetic polynucleotide sequence
agtgcgataaccccatgaacca

SEQ ID NO: 52449 - DNA, 22 bp, Artificial sequence
  synthetic polynucleotide sequence
aggctgaggcagagaattggaa

SEQ ID NO: 52450 - DNA, 20 bp, Artificial sequence
  synthetic polynucleotide sequence
ccaggctggacaatggtgca

SEQ ID NO: 52451 - DNA, 18 bp, Artificial sequence
  synthetic polynucleotide sequence
cgggacctccaggggcga

SEQ ID NO: 52452 - DNA, 18 bp, Artificial sequence
  synthetic polynucleotide sequence
gccaagcccccgccggga

SEQ ID NO: 52453 - DNA, 20 bp, Artificial sequence
  synthetic polynucleotide sequence
atccctcggcaagctcacca

SEQ ID NO: 52454 - DNA, 20 bp, Artificial sequence
  synthetic polynucleotide sequence
ggtggcaggaggagggtgga

SEQ ID NO: 52455 - DNA, 19 bp, Artificial sequence
  synthetic polynucleotide sequence
cgcccatgacccgcgagga

SEQ ID NO: 52456 - DNA, 19 bp, Artificial sequence
  synthetic polynucleotide sequence
cagggcctcaccagggcga

SEQ ID NO: 52457 - DNA, 22 bp, Artificial sequence
  synthetic polynucleotide sequence
agggaaggcagtgtgtagagaa

SEQ ID NO: 52458 - DNA, 23 bp, Artificial sequence
  synthetic polynucleotide sequence
caacacacagacttcaatggaca

SEQ ID NO: 52459 - DNA, 25 bp, Artificial sequence
  synthetic polynucleotide sequence
ggagcatctacacctgaggacaaga

SEQ ID NO: 52460 - DNA, 20 bp, Artificial sequence
  synthetic polynucleotide sequence
attgagaggggccgggggaa

SEQ ID NO: 52461 - DNA, 20 bp, Artificial sequence
  synthetic polynucleotide sequence
ctgcagctggccatccgcaa

SEQ ID NO: 52462 - DNA, 20 bp, Artificial sequence
  synthetic polynucleotide sequence
caggacgccaccctgcgcga

SEQ ID NO: 52463 - DNA, 20 bp, Artificial sequence
  synthetic polynucleotide sequence
gccttcactgcagaagggga

SEQ ID NO: 52464 - DNA, 20 bp, Artificial sequence
  synthetic polynucleotide sequence
ccacatgccccacgatgaca

SEQ ID NO: 52465 - DNA, 20 bp, Artificial sequence
  synthetic polynucleotide sequence
ctgccatccccccagctcca

SEQ ID NO: 52466 - DNA, 18 bp, Artificial sequence
  synthetic polynucleotide sequence
ctcacacggggcccccca

SEQ ID NO: 52467 - DNA, 25 bp, Artificial sequence
  synthetic polynucleotide sequence
agcacagagtagagaacaactggca

SEQ ID NO: 52468 - DNA, 23 bp, Artificial sequence
  synthetic polynucleotide sequence
ctacacagaagtgggcaatgaca

SEQ ID NO: 52469 - DNA, 20 bp, Artificial sequence
  synthetic polynucleotide sequence
taccccgaaaccggccccga

SEQ ID NO: 52470 - DNA, 19 bp, Artificial sequence
  synthetic polynucleotide sequence
gtgggctcggaggcagcga

SEQ ID NO: 52471 - DNA, 22 bp, Artificial sequence
  synthetic polynucleotide sequence
gggattacagggaccactgaca

SEQ ID NO: 52472 - DNA, 23 bp, Artificial sequence
  synthetic polynucleotide sequence
gacagcaatacccaggaagacca

SEQ ID NO: 52473 - DNA, 21 bp, Artificial sequence
  synthetic polynucleotide sequence
aagcactggatgagtcgggaa

SEQ ID NO: 52474 - DNA, 20 bp, Artificial sequence
  synthetic polynucleotide sequence
tggtgccaacctcaacggga

SEQ ID NO: 52475 - DNA, 22 bp, Artificial sequence
  synthetic polynucleotide sequence
aactggacagaacacttgggaa

SEQ ID NO: 52476 - DNA, 21 bp, Artificial sequence
  synthetic polynucleotide sequence
agattcctgacagcacaggga

SEQ ID NO: 52477 - DNA, 20 bp, Artificial sequence
  synthetic polynucleotide sequence
gaggggctaggctgacccca

SEQ ID NO: 52478 - DNA, 21 bp, Artificial sequence
  synthetic polynucleotide sequence
tgtggggaaagaagggtagga

SEQ ID NO: 52479 - DNA, 20 bp, Artificial sequence
  synthetic polynucleotide sequence
gaactgggctctggggagga

SEQ ID NO: 52480 - DNA, 21 bp, Artificial sequence
  synthetic polynucleotide sequence
gctccaagtaaagccaggcca

SEQ ID NO: 52481 - DNA, 23 bp, Artificial sequence
  synthetic polynucleotide sequence
gacaacaaaaacggacaaggcca

SEQ ID NO: 52482 - DNA, 20 bp, Artificial sequence
  synthetic polynucleotide sequence
gtggagaggctggcctcaga

SEQ ID NO: 52483 - DNA, 25 bp, Artificial sequence
  synthetic polynucleotide sequence
gacctagactggatacgaactagca

SEQ ID NO: 52484 - DNA, 21 bp, Artificial sequence
  synthetic polynucleotide sequence
gtatgatcccagcgcagagca

SEQ ID NO: 52485 - DNA, 20 bp, Artificial sequence
  synthetic polynucleotide sequence
aacgagcaccggaagcggca

SEQ ID NO: 52486 - DNA, 20 bp, Artificial sequence
  synthetic polynucleotide sequence
aaaggcccctcctcgacgca

SEQ ID NO: 52487 - DNA, 19 bp, Artificial sequence
  synthetic polynucleotide sequence
gccagccggacctggagga

SEQ ID NO: 52488 - DNA, 20 bp, Artificial sequence
  synthetic polynucleotide sequence
tccagctgcctcccagggga

SEQ ID NO: 52489 - DNA, 21 bp, Artificial sequence
  synthetic polynucleotide sequence
gcgagaagcgcgtcaagaaga

SEQ ID NO: 52490 - DNA, 20 bp, Artificial sequence
  synthetic polynucleotide sequence
caccaggacggggtggcgca

SEQ ID NO: 52491 - DNA, 25 bp, Artificial sequence
  synthetic polynucleotide sequence
atcaggccctcacagaagatgaaca

SEQ ID NO: 52492 - DNA, 21 bp, Artificial sequence
  synthetic polynucleotide sequence
taaaacgccgtgtctagggga

SEQ ID NO: 52493 - DNA, 20 bp, Artificial sequence
  synthetic polynucleotide sequence
caagggggcggtttccccca

SEQ ID NO: 52494 - DNA, 21 bp, Artificial sequence
  synthetic polynucleotide sequence
atggctgggaaagcctcagaa

SEQ ID NO: 52495 - DNA, 23 bp, Artificial sequence
  synthetic polynucleotide sequence
gtcagaggaaaaggaggcctaga

SEQ ID NO: 52496 - DNA, 20 bp, Artificial sequence
  synthetic polynucleotide sequence
ctggcctgggagtcagaaga

SEQ ID NO: 52497 - DNA, 23 bp, Artificial sequence
  synthetic polynucleotide sequence
gaaatggcagcaaaggaaacgga

SEQ ID NO: 52498 - DNA, 21 bp, Artificial sequence
  synthetic polynucleotide sequence
aatctaggaatcggagcagga

SEQ ID NO: 52499 - DNA, 20 bp, Artificial sequence
  synthetic polynucleotide sequence
gtgcaggaccttcgcagcga

SEQ ID NO: 52500 - DNA, 25 bp, Artificial sequence
  synthetic polynucleotide sequence
aagccccaaaaagatcatgctggca

SEQ ID NO: 52501 - DNA, 20 bp, Artificial sequence
  synthetic polynucleotide sequence
catccagtggccacgtggaa

SEQ ID NO: 52502 - DNA, 19 bp, Artificial sequence
  synthetic polynucleotide sequence
ggggggcggggggtatgca

SEQ ID NO: 52503 - DNA, 19 bp, Artificial sequence
  synthetic polynucleotide sequence
cagccccccctgagcccca

SEQ ID NO: 52504 - DNA, 20 bp, Artificial sequence
  synthetic polynucleotide sequence
tgtgggccaggagtcaggga

SEQ ID NO: 52505 - DNA, 20 bp, Artificial sequence
  synthetic polynucleotide sequence
aggccagagactctgggtga

SEQ ID NO: 52506 - DNA, 20 bp, Artificial sequence
  synthetic polynucleotide sequence
ggcagctgagacggcaagca

SEQ ID NO: 52507 - DNA, 20 bp, Artificial sequence
  synthetic polynucleotide sequence
ttggggcctggggcagagga

SEQ ID NO: 52508 - DNA, 20 bp, Artificial sequence
  synthetic polynucleotide sequence
cagcgacaccaggctgtgca

SEQ ID NO: 52509 - DNA, 20 bp, Artificial sequence
  synthetic polynucleotide sequence
ccactggccctaccatggga

SEQ ID NO: 52510 - DNA, 20 bp, Artificial sequence
  synthetic polynucleotide sequence
taagcaggggagtggaggga

SEQ ID NO: 52511 - DNA, 22 bp, Artificial sequence
  synthetic polynucleotide sequence
tgaagagacaggctttgggaga

SEQ ID NO: 52512 - DNA, 20 bp, Artificial sequence
  synthetic polynucleotide sequence
aaccgagggccacacggaga

SEQ ID NO: 52513 - DNA, 21 bp, Artificial sequence
  synthetic polynucleotide sequence
ggcttcgtcaggagaaccaga

SEQ ID NO: 52514 - DNA, 20 bp, Artificial sequence
  synthetic polynucleotide sequence
gtccaccaggctgggaggca

SEQ ID NO: 52515 - DNA, 20 bp, Artificial sequence
  synthetic polynucleotide sequence
ctgcacgagagagggctgaa

SEQ ID NO: 52516 - DNA, 20 bp, Artificial sequence
  synthetic polynucleotide sequence
tcaaaggggttgggggcaga

SEQ ID NO: 52517 - DNA, 20 bp, Artificial sequence
  synthetic polynucleotide sequence
gccaaggccttgcaggcaga

SEQ ID NO: 52518 - DNA, 25 bp, Artificial sequence
  synthetic polynucleotide sequence
aaagaaagggaccgaaagcccaaga

SEQ ID NO: 52519 - DNA, 20 bp, Artificial sequence
  synthetic polynucleotide sequence
tgccagggacccaggctcca

SEQ ID NO: 52520 - DNA, 22 bp, Artificial sequence
  synthetic polynucleotide sequence
tgaacagtcatgccacaaggca

SEQ ID NO: 52521 - DNA, 20 bp, Artificial sequence
  synthetic polynucleotide sequence
gtgccctgcatggagagaga

SEQ ID NO: 52522 - DNA, 20 bp, Artificial sequence
  synthetic polynucleotide sequence
gggggctactaaacggggga

SEQ ID NO: 52523 - DNA, 22 bp, Artificial sequence
  synthetic polynucleotide sequence
tttcaactccacagtccacaca

SEQ ID NO: 52524 - DNA, 25 bp, Artificial sequence
  synthetic polynucleotide sequence
gaagcagagatcaaggagaaaggga

SEQ ID NO: 52525 - DNA, 20 bp, Artificial sequence
  synthetic polynucleotide sequence
ctggggccctgccctgacaa

SEQ ID NO: 52526 - DNA, 20 bp, Artificial sequence
  synthetic polynucleotide sequence
tcacaggggcgatcggagga

SEQ ID NO: 52527 - DNA, 20 bp, Artificial sequence
  synthetic polynucleotide sequence
gggcaacagctgacggggaa

SEQ ID NO: 52528 - DNA, 20 bp, Artificial sequence
  synthetic polynucleotide sequence
tagcagaggaggcgttccca

SEQ ID NO: 52529 - DNA, 23 bp, Artificial sequence
  synthetic polynucleotide sequence
cgccaacaggcggatgaagagaa

SEQ ID NO: 52530 - DNA, 22 bp, Artificial sequence
  synthetic polynucleotide sequence
aaaggaaaaagggtcgtcccca

SEQ ID NO: 52531 - DNA, 20 bp, Artificial sequence
  synthetic polynucleotide sequence
acaggctcaaccgcttccga

SEQ ID NO: 52532 - DNA, 20 bp, Artificial sequence
  synthetic polynucleotide sequence
gagaagaccctggctcccca

SEQ ID NO: 52533 - DNA, 20 bp, Artificial sequence
  synthetic polynucleotide sequence
gagcttccgagaccggcaga

SEQ ID NO: 52534 - DNA, 20 bp, Artificial sequence
  synthetic polynucleotide sequence
ggcctgagcaggctgtcaga

SEQ ID NO: 52535 - DNA, 20 bp, Artificial sequence
  synthetic polynucleotide sequence
gaagtccttcccacccccca

SEQ ID NO: 52536 - DNA, 25 bp, Artificial sequence
  synthetic polynucleotide sequence
tagggggacagaagttacaggcaga

SEQ ID NO: 52537 - DNA, 23 bp, Artificial sequence
  synthetic polynucleotide sequence
catccacagagcagagatctcaa

SEQ ID NO: 52538 - DNA, 25 bp, Artificial sequence
  synthetic polynucleotide sequence
aaatcccaagagaccagcaagtgca

SEQ ID NO: 52539 - DNA, 20 bp, Artificial sequence
  synthetic polynucleotide sequence
gagaaggctgcgggtctcca

SEQ ID NO: 52540 - DNA, 20 bp, Artificial sequence
  synthetic polynucleotide sequence
agagcccgcgtcgtcctgca

SEQ ID NO: 52541 - DNA, 23 bp, Artificial sequence
  synthetic polynucleotide sequence
cccaatgcagagaagcggaccga

SEQ ID NO: 52542 - DNA, 20 bp, Artificial sequence
  synthetic polynucleotide sequence
gctagaagggggcctcagga

SEQ ID NO: 52543 - DNA, 23 bp, Artificial sequence
  synthetic polynucleotide sequence
gagtcagggaagatgaatgcaga

SEQ ID NO: 52544 - DNA, 25 bp, Artificial sequence
  synthetic polynucleotide sequence
aagctgtcaactgggactgaagaga

SEQ ID NO: 52545 - DNA, 20 bp, Artificial sequence
  synthetic polynucleotide sequence
ccttcacataccccacccca

SEQ ID NO: 52546 - DNA, 20 bp, Artificial sequence
  synthetic polynucleotide sequence
acagcagctaaaggccccga

SEQ ID NO: 52547 - DNA, 21 bp, Artificial sequence
  synthetic polynucleotide sequence
aaggcaaggtagactctccca

SEQ ID NO: 52548 - DNA, 23 bp, Artificial sequence
  synthetic polynucleotide sequence
ctaaacgaaccacactgctacca

SEQ ID NO: 52549 - DNA, 25 bp, Artificial sequence
  synthetic polynucleotide sequence
gaagaagagagagctagagccagaa

SEQ ID NO: 52550 - DNA, 25 bp, Artificial sequence
  synthetic polynucleotide sequence
taggtatgggagaagctaccagaca

SEQ ID NO: 52551 - DNA, 22 bp, Artificial sequence
  synthetic polynucleotide sequence
ccacgaagggacactgaagaca

SEQ ID NO: 52552 - DNA, 22 bp, Artificial sequence
  synthetic polynucleotide sequence
caaaacgctactggtagcagga

SEQ ID NO: 52553 - DNA, 18 bp, Artificial sequence
  synthetic polynucleotide sequence
cgtggtggtgagtggcaa

SEQ ID NO: 52554 - DNA, 18 bp, Artificial sequence
  synthetic polynucleotide sequence
agtgggccagagtgcaca

SEQ ID NO: 52555 - DNA, 21 bp, Artificial sequence
  synthetic polynucleotide sequence
agtcctcacaggatgagccca

SEQ ID NO: 52556 - DNA, 20 bp, Artificial sequence
  synthetic polynucleotide sequence
gcgtacacagggtcctggga

SEQ ID NO: 52557 - DNA, 20 bp, Artificial sequence
  synthetic polynucleotide sequence
acacctggcatcgggcggca

SEQ ID NO: 52558 - DNA, 20 bp, Artificial sequence
  synthetic polynucleotide sequence
taactggggggacaggagga

SEQ ID NO: 52559 - DNA, 20 bp, Artificial sequence
  synthetic polynucleotide sequence
ccccataccaggaacccaga

SEQ ID NO: 52560 - DNA, 22 bp, Artificial sequence
  synthetic polynucleotide sequence
cagactcgtcacatggcaagca

SEQ ID NO: 52561 - DNA, 20 bp, Artificial sequence
  synthetic polynucleotide sequence
ccagacgaggaggacgtaga

SEQ ID NO: 52562 - DNA, 20 bp, Artificial sequence
  synthetic polynucleotide sequence
gggaatgacgtcgccccgca

SEQ ID NO: 52563 - DNA, 21 bp, Artificial sequence
  synthetic polynucleotide sequence
tctggtacaggagaagcccaa

SEQ ID NO: 52564 - DNA, 25 bp, Artificial sequence
  synthetic polynucleotide sequence
caaggaactcaagccaggtgatgca

SEQ ID NO: 52565 - DNA, 20 bp, Artificial sequence
  synthetic polynucleotide sequence
cctccaggctctcccggaga

SEQ ID NO: 52566 - DNA, 20 bp, Artificial sequence
  synthetic polynucleotide sequence
tccagaaccagctctgccca

SEQ ID NO: 52567 - DNA, 21 bp, Artificial sequence
  synthetic polynucleotide sequence
ccatccccacaaagaaccgca

SEQ ID NO: 52568 - DNA, 20 bp, Artificial sequence
  synthetic polynucleotide sequence
agcaggcagtggggtgggga

SEQ ID NO: 52569 - DNA, 25 bp, Artificial sequence
  synthetic polynucleotide sequence
cagagaagccttacaaatgcagcga

SEQ ID NO: 52570 - DNA, 25 bp, Artificial sequence
  synthetic polynucleotide sequence
caagatgggcagtaaagcctgaaca

SEQ ID NO: 52571 - DNA, 20 bp, Artificial sequence
  synthetic polynucleotide sequence
gtgggcgagcacatgaagga

SEQ ID NO: 52572 - DNA, 20 bp, Artificial sequence
  synthetic polynucleotide sequence
gtagaagcagccaaggggca

SEQ ID NO: 52573 - DNA, 19 bp, Artificial sequence
  synthetic polynucleotide sequence
gccccaacgcggacctcga

SEQ ID NO: 52574 - DNA, 18 bp, Artificial sequence
  synthetic polynucleotide sequence
cgggaagggcgcggggaa

SEQ ID NO: 52575 - DNA, 20 bp, Artificial sequence
  synthetic polynucleotide sequence
ggaccccttggaagcctaga

SEQ ID NO: 52576 - DNA, 21 bp, Artificial sequence
  synthetic polynucleotide sequence
ttgccactcctccagagagaa

SEQ ID NO: 52577 - DNA, 20 bp, Artificial sequence
  synthetic polynucleotide sequence
cccagcaccctcaaggtaga

SEQ ID NO: 52578 - DNA, 23 bp, Artificial sequence
  synthetic polynucleotide sequence
caaagctcacagcaacaacccga

SEQ ID NO: 52579 - DNA, 25 bp, Artificial sequence
  synthetic polynucleotide sequence
acagaacacgtacatcctcccagaa

SEQ ID NO: 52580 - DNA, 22 bp, Artificial sequence
  synthetic polynucleotide sequence
aggactggtgaaactcagggaa

SEQ ID NO: 52581 - DNA, 20 bp, Artificial sequence
  synthetic polynucleotide sequence
gtggccctggagagctccca

SEQ ID NO: 52582 - DNA, 20 bp, Artificial sequence
  synthetic polynucleotide sequence
gccaaggacttggtcccgga

SEQ ID NO: 52583 - DNA, 22 bp, Artificial sequence
  synthetic polynucleotide sequence
aggacctataggcacctgaaga

SEQ ID NO: 52584 - DNA, 20 bp, Artificial sequence
  synthetic polynucleotide sequence
agcacaggttgccactggca

SEQ ID NO: 52585 - DNA, 22 bp, Artificial sequence
  synthetic polynucleotide sequence
aaggttctccagaaaaccacca

SEQ ID NO: 52586 - DNA, 25 bp, Artificial sequence
  synthetic polynucleotide sequence
ggagtcagaatggatgacatccaca

SEQ ID NO: 52587 - DNA, 20 bp, Artificial sequence
  synthetic polynucleotide sequence
ttcgccccgggagctgggaa

SEQ ID NO: 52588 - DNA, 25 bp, Artificial sequence
  synthetic polynucleotide sequence
gatgggagagggttaagaagaagga

SEQ ID NO: 52589 - DNA, 20 bp, Artificial sequence
  synthetic polynucleotide sequence
atgacgtcaggccccgggca

SEQ ID NO: 52590 - DNA, 20 bp, Artificial sequence
  synthetic polynucleotide sequence
cctcagctgaaccgctggga

SEQ ID NO: 52591 - DNA, 20 bp, Artificial sequence
  synthetic polynucleotide sequence
ccacttccccctggggagca

SEQ ID NO: 52592 - DNA, 20 bp, Artificial sequence
  synthetic polynucleotide sequence
ccatgcctgtggaggcccga

SEQ ID NO: 52593 - DNA, 22 bp, Artificial sequence
  synthetic polynucleotide sequence
tcaggagcaaacagtcagcgaa

SEQ ID NO: 52594 - DNA, 20 bp, Artificial sequence
  synthetic polynucleotide sequence
tctccacgagacaggcagca

SEQ ID NO: 52595 - DNA, 20 bp, Artificial sequence
  synthetic polynucleotide sequence
gctggtgtagccacagcaga

SEQ ID NO: 52596 - DNA, 20 bp, Artificial sequence
  synthetic polynucleotide sequence
agctggcctgggcatcggca

SEQ ID NO: 52597 - DNA, 21 bp, Artificial sequence
  synthetic polynucleotide sequence
gagcctctcagtaggagcaga

SEQ ID NO: 52598 - DNA, 21 bp, Artificial sequence
  synthetic polynucleotide sequence
aggagtaggcagaagatggca

SEQ ID NO: 52599 - DNA, 20 bp, Artificial sequence
  synthetic polynucleotide sequence
tacagaccgtcccccagaca

SEQ ID NO: 52600 - DNA, 20 bp, Artificial sequence
  synthetic polynucleotide sequence
cctgcccagtagctgcagga

SEQ ID NO: 52601 - DNA, 19 bp, Artificial sequence
  synthetic polynucleotide sequence
ctgggctgtgcggggccga

SEQ ID NO: 52602 - DNA, 20 bp, Artificial sequence
  synthetic polynucleotide sequence
gggatgtctgcaggccaaca

SEQ ID NO: 52603 - DNA, 20 bp, Artificial sequence
  synthetic polynucleotide sequence
caccgagaccactgaagcca

SEQ ID NO: 52604 - DNA, 20 bp, Artificial sequence
  synthetic polynucleotide sequence
gctccaagccttcagcagca

SEQ ID NO: 52605 - DNA, 20 bp, Artificial sequence
  synthetic polynucleotide sequence
gcagtgcactggctcaccaa

SEQ ID NO: 52606 - DNA, 23 bp, Artificial sequence
  synthetic polynucleotide sequence
gtaaatcgcagtgaggaggcaga

SEQ ID NO: 52607 - DNA, 20 bp, Artificial sequence
  synthetic polynucleotide sequence
acagcaggctctgaagggga

SEQ ID NO: 52608 - DNA, 20 bp, Artificial sequence
  synthetic polynucleotide sequence
ggctgacagctggggagaca

SEQ ID NO: 52609 - DNA, 20 bp, Artificial sequence
  synthetic polynucleotide sequence
ctttcggcgccaaccacaca

SEQ ID NO: 52610 - DNA, 22 bp, Artificial sequence
  synthetic polynucleotide sequence
tgaatgcaggcagcaaagtcca

SEQ ID NO: 52611 - DNA, 20 bp, Artificial sequence
  synthetic polynucleotide sequence
cgacgggtcagctcctccca

SEQ ID NO: 52612 - DNA, 21 bp, Artificial sequence
  synthetic polynucleotide sequence
agctcagtctcacagcaagca

SEQ ID NO: 52613 - DNA, 20 bp, Artificial sequence
  synthetic polynucleotide sequence
gcagcaccctcaagtggaca

SEQ ID NO: 52614 - DNA, 20 bp, Artificial sequence
  synthetic polynucleotide sequence
tggcagggagcaggcctcga

SEQ ID NO: 52615 - DNA, 23 bp, Artificial sequence
  synthetic polynucleotide sequence
cttcatcatacaaaccctcacca

SEQ ID NO: 52616 - DNA, 20 bp, Artificial sequence
  synthetic polynucleotide sequence
gagagaccactctggtggga

SEQ ID NO: 52617 - DNA, 20 bp, Artificial sequence
  synthetic polynucleotide sequence
gggaacagctgcgatgggga

SEQ ID NO: 52618 - DNA, 21 bp, Artificial sequence
  synthetic polynucleotide sequence
ccagtaagagacgggcagaga

SEQ ID NO: 52619 - DNA, 20 bp, Artificial sequence
  synthetic polynucleotide sequence
gcatggaagggctcactgca

SEQ ID NO: 52620 - DNA, 20 bp, Artificial sequence
  synthetic polynucleotide sequence
gggcttaagcagtcccccca

SEQ ID NO: 52621 - DNA, 20 bp, Artificial sequence
  synthetic polynucleotide sequence
gctacgaccaagtacgccca

SEQ ID NO: 52622 - DNA, 21 bp, Artificial sequence
  synthetic polynucleotide sequence
caccatgcaagggtcccaaga

SEQ ID NO: 52623 - DNA, 20 bp, Artificial sequence
  synthetic polynucleotide sequence
gagtatgcagggggtgggga

SEQ ID NO: 52624 - DNA, 22 bp, Artificial sequence
  synthetic polynucleotide sequence
caaaatcgcccaccttcacaca

SEQ ID NO: 52625 - DNA, 20 bp, Artificial sequence
  synthetic polynucleotide sequence
cagccacaaccacagccaca

SEQ ID NO: 52626 - DNA, 21 bp, Artificial sequence
  synthetic polynucleotide sequence
aaaacactggctgctgcagga

SEQ ID NO: 52627 - DNA, 20 bp, Artificial sequence
  synthetic polynucleotide sequence
gggctgggcctgtgggaaca

SEQ ID NO: 52628 - DNA, 18 bp, Artificial sequence
  synthetic polynucleotide sequence
ccagcggcagtgggcgga

SEQ ID NO: 52629 - DNA, 21 bp, Artificial sequence
  synthetic polynucleotide sequence
ggtagcacacagctgtgagga

SEQ ID NO: 52630 - DNA, 23 bp, Artificial sequence
  synthetic polynucleotide sequence
gctggtaggaatctgagcgcaca

SEQ ID NO: 52631 - DNA, 25 bp, Artificial sequence
  synthetic polynucleotide sequence
tggacctggaaacatccaacaagga

SEQ ID NO: 52632 - DNA, 25 bp, Artificial sequence
  synthetic polynucleotide sequence
ccactgacaacacaaactcctccaa

SEQ ID NO: 52633 - DNA, 25 bp, Artificial sequence
  synthetic polynucleotide sequence
cctgagcaacaagagcaaaactcca

SEQ ID NO: 52634 - DNA, 25 bp, Artificial sequence
  synthetic polynucleotide sequence
ctgagaagatgtggcaagaagcaga

SEQ ID NO: 52635 - DNA, 20 bp, Artificial sequence
  synthetic polynucleotide sequence
ggaggagcttcgcggtgcca

SEQ ID NO: 52636 - DNA, 20 bp, Artificial sequence
  synthetic polynucleotide sequence
gactggcctgggaagctaga

SEQ ID NO: 52637 - DNA, 20 bp, Artificial sequence
  synthetic polynucleotide sequence
tgatggagctgcccagggca

SEQ ID NO: 52638 - DNA, 20 bp, Artificial sequence
  synthetic polynucleotide sequence
gcgctgccattgcaggaaga

SEQ ID NO: 52639 - DNA, 21 bp, Artificial sequence
  synthetic polynucleotide sequence
gaggaggaagagtctgcagca

SEQ ID NO: 52640 - DNA, 20 bp, Artificial sequence
  synthetic polynucleotide sequence
ttgggagaggccacctgaca

SEQ ID NO: 52641 - DNA, 20 bp, Artificial sequence
  synthetic polynucleotide sequence
ctcagcctcagccttcgaga

SEQ ID NO: 52642 - DNA, 19 bp, Artificial sequence
  synthetic polynucleotide sequence
gcaccctggtcgtggagga

SEQ ID NO: 52643 - DNA, 20 bp, Artificial sequence
  synthetic polynucleotide sequence
ggaggagaacgtggatggca

SEQ ID NO: 52644 - DNA, 19 bp, Artificial sequence
  synthetic polynucleotide sequence
gaggctggggcgcgtcgca

SEQ ID NO: 52645 - DNA, 20 bp, Artificial sequence
  synthetic polynucleotide sequence
tcctcacccacccgagccca

SEQ ID NO: 52646 - DNA, 25 bp, Artificial sequence
  synthetic polynucleotide sequence
ttaagaagggaagataggcagggca

SEQ ID NO: 52647 - DNA, 20 bp, Artificial sequence
  synthetic polynucleotide sequence
agacgacaccgagtgccaca

SEQ ID NO: 52648 - DNA, 20 bp, Artificial sequence
  synthetic polynucleotide sequence
actctggagaaggcacggca

SEQ ID NO: 52649 - DNA, 20 bp, Artificial sequence
  synthetic polynucleotide sequence
cgggagtgatcagtcggaca

SEQ ID NO: 52650 - DNA, 25 bp, Artificial sequence
  synthetic polynucleotide sequence
gagcaggtatagaagctcagagaca

SEQ ID NO: 52651 - DNA, 22 bp, Artificial sequence
  synthetic polynucleotide sequence
caagaagatccaaggactgcca

SEQ ID NO: 52652 - DNA, 20 bp, Artificial sequence
  synthetic polynucleotide sequence
tggcagcatcagcgaggcca

SEQ ID NO: 52653 - DNA, 20 bp, Artificial sequence
  synthetic polynucleotide sequence
gcagccacagcacacaagga

SEQ ID NO: 52654 - DNA, 20 bp, Artificial sequence
  synthetic polynucleotide sequence
cccactcctacgcacatgca

SEQ ID NO: 52655 - DNA, 20 bp, Artificial sequence
  synthetic polynucleotide sequence
aagctggacctggcctgaga

SEQ ID NO: 52656 - DNA, 18 bp, Artificial sequence
  synthetic polynucleotide sequence
ggccatggcaggcgggga

SEQ ID NO: 52657 - DNA, 20 bp, Artificial sequence
  synthetic polynucleotide sequence
ggacagctgctcgcggaaca

SEQ ID NO: 52658 - DNA, 20 bp, Artificial sequence
  synthetic polynucleotide sequence
gaaagactggccccgtagca

SEQ ID NO: 52659 - DNA, 22 bp, Artificial sequence
  synthetic polynucleotide sequence
gccacaacaagtatgcagggga

SEQ ID NO: 52660 - DNA, 20 bp, Artificial sequence
  synthetic polynucleotide sequence
ccaggccttggaagggtcca

SEQ ID NO: 52661 - DNA, 20 bp, Artificial sequence
  synthetic polynucleotide sequence
ctgaggccaggctccaggaa

SEQ ID NO: 52662 - DNA, 20 bp, Artificial sequence
  synthetic polynucleotide sequence
gttgagaaggggcgtcagca

SEQ ID NO: 52663 - DNA, 25 bp, Artificial sequence
  synthetic polynucleotide sequence
ggagggaaggatgagaagcaatgca

SEQ ID NO: 52664 - DNA, 20 bp, Artificial sequence
  synthetic polynucleotide sequence
ccacatgagtgcacccagca

SEQ ID NO: 52665 - DNA, 20 bp, Artificial sequence
  synthetic polynucleotide sequence
ctgaagagggctgcagggaa

SEQ ID NO: 52666 - DNA, 20 bp, Artificial sequence
  synthetic polynucleotide sequence
aggccagcgctcagcaccaa

SEQ ID NO: 52667 - DNA, 20 bp, Artificial sequence
  synthetic polynucleotide sequence
caagctgagctgggctgaca

SEQ ID NO: 52668 - DNA, 20 bp, Artificial sequence
  synthetic polynucleotide sequence
cagggccttcagcagaggga

SEQ ID NO: 52669 - DNA, 20 bp, Artificial sequence
  synthetic polynucleotide sequence
ttggcagcccgagacccaga

SEQ ID NO: 52670 - DNA, 23 bp, Artificial sequence
  synthetic polynucleotide sequence
gctgctgcagcgattcgacaaga

SEQ ID NO: 52671 - DNA, 22 bp, Artificial sequence
  synthetic polynucleotide sequence
agagggcccaagaccattcaca

SEQ ID NO: 52672 - DNA, 20 bp, Artificial sequence
  synthetic polynucleotide sequence
ggcactagaccctcacccca

SEQ ID NO: 52673 - DNA, 23 bp, Artificial sequence
  synthetic polynucleotide sequence
gtggacatcacagtgctcaagga

SEQ ID NO: 52674 - DNA, 20 bp, Artificial sequence
  synthetic polynucleotide sequence
tggatggggacacggtcaca

SEQ ID NO: 52675 - DNA, 21 bp, Artificial sequence
  synthetic polynucleotide sequence
gaggttctcacagcagagcca

SEQ ID NO: 52676 - DNA, 20 bp, Artificial sequence
  synthetic polynucleotide sequence
aaacacagtcctcggggcca

SEQ ID NO: 52677 - DNA, 22 bp, Artificial sequence
  synthetic polynucleotide sequence
gccaggggcaaattcaaggaga

SEQ ID NO: 52678 - DNA, 20 bp, Artificial sequence
  synthetic polynucleotide sequence
tgatgccccagaggcaggca

SEQ ID NO: 52679 - DNA, 20 bp, Artificial sequence
  synthetic polynucleotide sequence
ctcacccctctcaggagaca

SEQ ID NO: 52680 - DNA, 20 bp, Artificial sequence
  synthetic polynucleotide sequence
tggggcagtctgagccagga

SEQ ID NO: 52681 - DNA, 21 bp, Artificial sequence
  synthetic polynucleotide sequence
ggcaaggctcaggatcctaga

SEQ ID NO: 52682 - DNA, 20 bp, Artificial sequence
  synthetic polynucleotide sequence
gggacagtaaggctggcaga

SEQ ID NO: 52683 - DNA, 21 bp, Artificial sequence
  synthetic polynucleotide sequence
aggactgagagagccttgcaa

SEQ ID NO: 52684 - DNA, 20 bp, Artificial sequence
  synthetic polynucleotide sequence
tggtgaggcctagcccagca

SEQ ID NO: 52685 - DNA, 22 bp, Artificial sequence
  synthetic polynucleotide sequence
agcacaaagggcacactccaga

SEQ ID NO: 52686 - DNA, 22 bp, Artificial sequence
  synthetic polynucleotide sequence
tgcctgaagtcacacagcaaga

SEQ ID NO: 52687 - DNA, 21 bp, Artificial sequence
  synthetic polynucleotide sequence
ataccacgaagctgtccggaa

SEQ ID NO: 52688 - DNA, 20 bp, Artificial sequence
  synthetic polynucleotide sequence
cctggatcatgggaccacca

SEQ ID NO: 52689 - DNA, 19 bp, Artificial sequence
  synthetic polynucleotide sequence
cgggcagccaggcccagaa

SEQ ID NO: 52690 - DNA, 20 bp, Artificial sequence
  synthetic polynucleotide sequence
ctgctaggggagggaggcca

SEQ ID NO: 52691 - DNA, 20 bp, Artificial sequence
  synthetic polynucleotide sequence
gcgggtttccacccccagga

SEQ ID NO: 52692 - DNA, 20 bp, Artificial sequence
  synthetic polynucleotide sequence
catggggcctgcaaggcgca

SEQ ID NO: 52693 - DNA, 20 bp, Artificial sequence
  synthetic polynucleotide sequence
agcccggacctctcctggca

SEQ ID NO: 52694 - DNA, 20 bp, Artificial sequence
  synthetic polynucleotide sequence
ggggtgagcggagtagggga

SEQ ID NO: 52695 - DNA, 25 bp, Artificial sequence
  synthetic polynucleotide sequence
ggaactggagaaatggaaagtggca

SEQ ID NO: 52696 - DNA, 22 bp, Artificial sequence
  synthetic polynucleotide sequence
tcatcgaacgctggcatcacca

SEQ ID NO: 52697 - DNA, 20 bp, Artificial sequence
  synthetic polynucleotide sequence
atctgggcagtaaccggcca

SEQ ID NO: 52698 - DNA, 23 bp, Artificial sequence
  synthetic polynucleotide sequence
caaaaatagcaaaggccccaaca

SEQ ID NO: 52699 - DNA, 20 bp, Artificial sequence
  synthetic polynucleotide sequence
gtcgctgccacagctggcca

SEQ ID NO: 52700 - DNA, 23 bp, Artificial sequence
  synthetic polynucleotide sequence
ctttgacaagagacacctgcaca

SEQ ID NO: 52701 - DNA, 20 bp, Artificial sequence
  synthetic polynucleotide sequence
caccggcctggcaagaagga

SEQ ID NO: 52702 - DNA, 20 bp, Artificial sequence
  synthetic polynucleotide sequence
tccatgatggccggcacgca

SEQ ID NO: 52703 - DNA, 25 bp, Artificial sequence
  synthetic polynucleotide sequence
aaggacaaactgcagggaactacca

SEQ ID NO: 52704 - DNA, 20 bp, Artificial sequence
  synthetic polynucleotide sequence
aaactgctgcaccagcggca

SEQ ID NO: 52705 - DNA, 20 bp, Artificial sequence
  synthetic polynucleotide sequence
cagccctcagagcctgcaga

SEQ ID NO: 52706 - DNA, 20 bp, Artificial sequence
  synthetic polynucleotide sequence
ggtctggcaaccaggcaaga

SEQ ID NO: 52707 - DNA, 22 bp, Artificial sequence
  synthetic polynucleotide sequence
ccacctgctacctaacagccaa

SEQ ID NO: 52708 - DNA, 22 bp, Artificial sequence
  synthetic polynucleotide sequence
gttggaagaagcagcctagaca

SEQ ID NO: 52709 - DNA, 25 bp, Artificial sequence
  synthetic polynucleotide sequence
gtactgcaaagccttccaagaccaa

SEQ ID NO: 52710 - DNA, 20 bp, Artificial sequence
  synthetic polynucleotide sequence
ggacacagcgctggcacaca

SEQ ID NO: 52711 - DNA, 21 bp, Artificial sequence
  synthetic polynucleotide sequence
tggactgccaattgccacaga

SEQ ID NO: 52712 - DNA, 20 bp, Artificial sequence
  synthetic polynucleotide sequence
catgtgggtggagaagggca

SEQ ID NO: 52713 - DNA, 21 bp, Artificial sequence
  synthetic polynucleotide sequence
agcacgcatgcatcacatgca

SEQ ID NO: 52714 - DNA, 21 bp, Artificial sequence
  synthetic polynucleotide sequence
aggaacaggtgcaaaccacca

SEQ ID NO: 52715 - DNA, 25 bp, Artificial sequence
  synthetic polynucleotide sequence
aatgcagaatcacagcccccagaga

SEQ ID NO: 52716 - DNA, 20 bp, Artificial sequence
  synthetic polynucleotide sequence
caaccaggatgggcctgaca

SEQ ID NO: 52717 - DNA, 20 bp, Artificial sequence
  synthetic polynucleotide sequence
tgtgcccggcccggagaaca

SEQ ID NO: 52718 - DNA, 21 bp, Artificial sequence
  synthetic polynucleotide sequence
agtaaagtggggaggaaggca

SEQ ID NO: 52719 - DNA, 20 bp, Artificial sequence
  synthetic polynucleotide sequence
gcagccactgtgctggggaa

SEQ ID NO: 52720 - DNA, 25 bp, Artificial sequence
  synthetic polynucleotide sequence
aggccagggacatgtcaatgaagga

SEQ ID NO: 52721 - DNA, 20 bp, Artificial sequence
  synthetic polynucleotide sequence
caagctggcttgcaccgaca

SEQ ID NO: 52722 - DNA, 20 bp, Artificial sequence
  synthetic polynucleotide sequence
acgagtggtgcacgtggaca

SEQ ID NO: 52723 - DNA, 20 bp, Artificial sequence
  synthetic polynucleotide sequence
tgcaggtccacccacaggga

SEQ ID NO: 52724 - DNA, 20 bp, Artificial sequence
  synthetic polynucleotide sequence
gggtggcagagaggaagaca

SEQ ID NO: 52725 - DNA, 20 bp, Artificial sequence
  synthetic polynucleotide sequence
cctcgccatgtgccagaaga

SEQ ID NO: 52726 - DNA, 22 bp, Artificial sequence
  synthetic polynucleotide sequence
caaaggccggactattgccaca

SEQ ID NO: 52727 - DNA, 25 bp, Artificial sequence
  synthetic polynucleotide sequence
gcagtatctggaatagcaggaagga

SEQ ID NO: 52728 - DNA, 21 bp, Artificial sequence
  synthetic polynucleotide sequence
ttaggaagcagtggagtgcca

SEQ ID NO: 52729 - DNA, 20 bp, Artificial sequence
  synthetic polynucleotide sequence
cccccagcagctgatgaaca

SEQ ID NO: 52730 - DNA, 21 bp, Artificial sequence
  synthetic polynucleotide sequence
ttttgagagagcaggcaggga

SEQ ID NO: 52731 - DNA, 19 bp, Artificial sequence
  synthetic polynucleotide sequence
cgcgcctgacccaggagga

SEQ ID NO: 52732 - DNA, 19 bp, Artificial sequence
  synthetic polynucleotide sequence
ggcgcaggagtcaggcgga

SEQ ID NO: 52733 - DNA, 20 bp, Artificial sequence
  synthetic polynucleotide sequence
ccacacagacccgctcagga

SEQ ID NO: 52734 - DNA, 20 bp, Artificial sequence
  synthetic polynucleotide sequence
ggtgtgagtcaccgcccgca

SEQ ID NO: 52735 - DNA, 20 bp, Artificial sequence
  synthetic polynucleotide sequence
caaaggagaggacaccgcca

SEQ ID NO: 52736 - DNA, 20 bp, Artificial sequence
  synthetic polynucleotide sequence
ggggttcatgccacagggaa

SEQ ID NO: 52737 - DNA, 20 bp, Artificial sequence
  synthetic polynucleotide sequence
ctggacactgctcagcagga

SEQ ID NO: 52738 - DNA, 20 bp, Artificial sequence
  synthetic polynucleotide sequence
gctccagacaggtgaccaga

SEQ ID NO: 52739 - DNA, 20 bp, Artificial sequence
  synthetic polynucleotide sequence
ctgtgcctgcaggagagcca

SEQ ID NO: 52740 - DNA, 20 bp, Artificial sequence
  synthetic polynucleotide sequence
tgatgggtcccaggcaggca

SEQ ID NO: 52741 - DNA, 20 bp, Artificial sequence
  synthetic polynucleotide sequence
ctgtgcagaacatgccggga

SEQ ID NO: 52742 - DNA, 25 bp, Artificial sequence
  synthetic polynucleotide sequence
gagcaggtatagaagctcagagaca

SEQ ID NO: 52743 - DNA, 20 bp, Artificial sequence
  synthetic polynucleotide sequence
caagcagggactttgggcca

SEQ ID NO: 52744 - DNA, 25 bp, Artificial sequence
  synthetic polynucleotide sequence
ctcccatgagaagagacaccatgga

SEQ ID NO: 52745 - DNA, 20 bp, Artificial sequence
  synthetic polynucleotide sequence
caaggagcagaggtggcaga

SEQ ID NO: 52746 - DNA, 20 bp, Artificial sequence
  synthetic polynucleotide sequence
gctccctctccccaaggcca

SEQ ID NO: 52747 - DNA, 20 bp, Artificial sequence
  synthetic polynucleotide sequence
ccagtggcaggactctggga

SEQ ID NO: 52748 - DNA, 22 bp, Artificial sequence
  synthetic polynucleotide sequence
tacagagggacatagtcatgca

SEQ ID NO: 52749 - DNA, 20 bp, Artificial sequence
  synthetic polynucleotide sequence
gtcaggggacagcacaggca

SEQ ID NO: 52750 - DNA, 20 bp, Artificial sequence
  synthetic polynucleotide sequence
ctcagggtgccctaggccca

SEQ ID NO: 52751 - DNA, 20 bp, Artificial sequence
  synthetic polynucleotide sequence
ccagcacatggatgggagca

SEQ ID NO: 52752 - DNA, 20 bp, Artificial sequence
  synthetic polynucleotide sequence
ttgcaggagaggaggcagga

SEQ ID NO: 52753 - DNA, 22 bp, Artificial sequence
  synthetic polynucleotide sequence
tcagctaccagcacagcatgca

SEQ ID NO: 52754 - DNA, 20 bp, Artificial sequence
  synthetic polynucleotide sequence
aggatggaggcaagctggca

SEQ ID NO: 52755 - DNA, 21 bp, Artificial sequence
  synthetic polynucleotide sequence
agggaaccacacactcaagca

SEQ ID NO: 52756 - DNA, 20 bp, Artificial sequence
  synthetic polynucleotide sequence
gtgagaagagcacacccgca

SEQ ID NO: 52757 - DNA, 23 bp, Artificial sequence
  synthetic polynucleotide sequence
ggggcaggagagtctgtgagaga

SEQ ID NO: 52758 - DNA, 25 bp, Artificial sequence
  synthetic polynucleotide sequence
gagaggaactgtagggaagaagaga

SEQ ID NO: 52759 - DNA, 20 bp, Artificial sequence
  synthetic polynucleotide sequence
ctcagccccatgccaccaca

SEQ ID NO: 52760 - DNA, 23 bp, Artificial sequence
  synthetic polynucleotide sequence
gttcaggaccagcctaaacaaca

SEQ ID NO: 52761 - DNA, 23 bp, Artificial sequence
  synthetic polynucleotide sequence
gtggacgagaaaagaacagtgga

SEQ ID NO: 52762 - DNA, 20 bp, Artificial sequence
  synthetic polynucleotide sequence
gtcacggggaccaagaacca

SEQ ID NO: 52763 - DNA, 25 bp, Artificial sequence
  synthetic polynucleotide sequence
cctcaaaggaaactatccagcagga

SEQ ID NO: 52764 - DNA, 23 bp, Artificial sequence
  synthetic polynucleotide sequence
ctaaaaccaagactgtcaggcaa

SEQ ID NO: 52765 - DNA, 22 bp, Artificial sequence
  synthetic polynucleotide sequence
ccgcagtatgcatggaagcaca

SEQ ID NO: 52766 - DNA, 25 bp, Artificial sequence
  synthetic polynucleotide sequence
gagcagagaaatcatcacagggaga

SEQ ID NO: 52767 - DNA, 21 bp, Artificial sequence
  synthetic polynucleotide sequence
agtccagagtcacccaaagca

SEQ ID NO: 52768 - DNA, 20 bp, Artificial sequence
  synthetic polynucleotide sequence
caaaggggctgaccatggga

SEQ ID NO: 52769 - DNA, 20 bp, Artificial sequence
  synthetic polynucleotide sequence
ctgcggctacccccagtgaa

SEQ ID NO: 52770 - DNA, 23 bp, Artificial sequence
  synthetic polynucleotide sequence
gtgtagctcatgggcaaaaagga

SEQ ID NO: 52771 - DNA, 20 bp, Artificial sequence
  synthetic polynucleotide sequence
caaaggaggcctgggctgca

SEQ ID NO: 52772 - DNA, 25 bp, Artificial sequence
  synthetic polynucleotide sequence
ctcagaagcagccagaaaaccaaga

SEQ ID NO: 52773 - DNA, 21 bp, Artificial sequence
  synthetic polynucleotide sequence
ggggcagatggagagaggcaa

SEQ ID NO: 52774 - DNA, 18 bp, Artificial sequence
  synthetic polynucleotide sequence
agctcggagcagccccca

SEQ ID NO: 52775 - DNA, 21 bp, Artificial sequence
  synthetic polynucleotide sequence
atcctgcagcagctcaaggga

SEQ ID NO: 52776 - DNA, 22 bp, Artificial sequence
  synthetic polynucleotide sequence
aaatccacatcatctccagcca

SEQ ID NO: 52777 - DNA, 20 bp, Artificial sequence
  synthetic polynucleotide sequence
catggtcctggacccagcaa

SEQ ID NO: 52778 - DNA, 23 bp, Artificial sequence
  synthetic polynucleotide sequence
gtgagtaaacgagggcagctgaa

SEQ ID NO: 52779 - DNA, 19 bp, Artificial sequence
  synthetic polynucleotide sequence
cagggagaggaggcgccga

SEQ ID NO: 52780 - DNA, 23 bp, Artificial sequence
  synthetic polynucleotide sequence
cttgtcaccactgggagaaagga

SEQ ID NO: 52781 - DNA, 23 bp, Artificial sequence
  synthetic polynucleotide sequence
ggaaaagatggtcccagcctgca

SEQ ID NO: 52782 - DNA, 20 bp, Artificial sequence
  synthetic polynucleotide sequence
accaggctagggagaaggga

SEQ ID NO: 52783 - DNA, 21 bp, Artificial sequence
  synthetic polynucleotide sequence
ggggacggacactcaagaaga

SEQ ID NO: 52784 - DNA, 22 bp, Artificial sequence
  synthetic polynucleotide sequence
ataggcccttgtggaaaagcca

SEQ ID NO: 52785 - DNA, 20 bp, Artificial sequence
  synthetic polynucleotide sequence
aagtgggggtggtggcagca

SEQ ID NO: 52786 - DNA, 20 bp, Artificial sequence
  synthetic polynucleotide sequence
tgaagcaccagtcagggcca

SEQ ID NO: 52787 - DNA, 22 bp, Artificial sequence
  synthetic polynucleotide sequence
atgagaaacatctacccaccga

SEQ ID NO: 52788 - DNA, 25 bp, Artificial sequence
  synthetic polynucleotide sequence
aaggcggaatcaatcctgaagggaa

SEQ ID NO: 52789 - DNA, 20 bp, Artificial sequence
  synthetic polynucleotide sequence
gccgtacaatgccaggagga

SEQ ID NO: 52790 - DNA, 22 bp, Artificial sequence
  synthetic polynucleotide sequence
aagcaaaagtggtgtgaggcca

SEQ ID NO: 52791 - DNA, 20 bp, Artificial sequence
  synthetic polynucleotide sequence
ggccagcttggcgggctaca

SEQ ID NO: 52792 - DNA, 23 bp, Artificial sequence
  synthetic polynucleotide sequence
caacagggaaaaggacaggaaga

SEQ ID NO: 52793 - DNA, 20 bp, Artificial sequence
  synthetic polynucleotide sequence
cgcgctgggaactggccaca

SEQ ID NO: 52794 - DNA, 20 bp, Artificial sequence
  synthetic polynucleotide sequence
ggggtggaaaaagagccgca

SEQ ID NO: 52795 - DNA, 21 bp, Artificial sequence
  synthetic polynucleotide sequence
tcaccttccccaatggcacca

SEQ ID NO: 52796 - DNA, 20 bp, Artificial sequence
  synthetic polynucleotide sequence
gagagcggaccagcacggca

SEQ ID NO: 52797 - DNA, 20 bp, Artificial sequence
  synthetic polynucleotide sequence
ggccagagtgttcaggccca

SEQ ID NO: 52798 - DNA, 25 bp, Artificial sequence
  synthetic polynucleotide sequence
aaagacaaaccacttgcactgccga

SEQ ID NO: 52799 - DNA, 20 bp, Artificial sequence
  synthetic polynucleotide sequence
aggagccagcgcctctgcga

SEQ ID NO: 52800 - DNA, 21 bp, Artificial sequence
  synthetic polynucleotide sequence
ttcaaagagagtggaggccca

SEQ ID NO: 52801 - DNA, 23 bp, Artificial sequence
  synthetic polynucleotide sequence
ggaaaggtgatcaagcaggggca

SEQ ID NO: 52802 - DNA, 20 bp, Artificial sequence
  synthetic polynucleotide sequence
cacaggtccccaaagtccca

SEQ ID NO: 52803 - DNA, 21 bp, Artificial sequence
  synthetic polynucleotide sequence
tgaaacgatcagcagcggaga

SEQ ID NO: 52804 - DNA, 20 bp, Artificial sequence
  synthetic polynucleotide sequence
tcgagggcactacagccaga

SEQ ID NO: 52805 - DNA, 20 bp, Artificial sequence
  synthetic polynucleotide sequence
ctctgggacgtggcgcgcga

SEQ ID NO: 52806 - DNA, 20 bp, Artificial sequence
  synthetic polynucleotide sequence
ctcgcagtagagcccgtgga

SEQ ID NO: 52807 - DNA, 21 bp, Artificial sequence
  synthetic polynucleotide sequence
gccttcctaaaccacccccaa

SEQ ID NO: 52808 - DNA, 21 bp, Artificial sequence
  synthetic polynucleotide sequence
gctgagttgcccagaagacca

SEQ ID NO: 52809 - DNA, 21 bp, Artificial sequence
  synthetic polynucleotide sequence
acaggagtagtaagctgggga

SEQ ID NO: 52810 - DNA, 20 bp, Artificial sequence
  synthetic polynucleotide sequence
gtccaaaggcacaggaggga

SEQ ID NO: 52811 - DNA, 19 bp, Artificial sequence
  synthetic polynucleotide sequence
gcaggctggagctggggga

SEQ ID NO: 52812 - DNA, 20 bp, Artificial sequence
  synthetic polynucleotide sequence
tcatcaggcgtcagaggcca

SEQ ID NO: 52813 - DNA, 20 bp, Artificial sequence
  synthetic polynucleotide sequence
gagccctatgagcgggacca

SEQ ID NO: 52814 - DNA, 20 bp, Artificial sequence
  synthetic polynucleotide sequence
gcagccttggggagatggca

SEQ ID NO: 52815 - DNA, 23 bp, Artificial sequence
  synthetic polynucleotide sequence
caaaacaaaggaggcagtgagca

SEQ ID NO: 52816 - DNA, 20 bp, Artificial sequence
  synthetic polynucleotide sequence
ccagaggtcagtcctcagga

SEQ ID NO: 52817 - DNA, 21 bp, Artificial sequence
  synthetic polynucleotide sequence
tgtgtaggacggcaacacaca

SEQ ID NO: 52818 - DNA, 21 bp, Artificial sequence
  synthetic polynucleotide sequence
aacacacacgtcgcacacaca

SEQ ID NO: 52819 - DNA, 18 bp, Artificial sequence
  synthetic polynucleotide sequence
ctggggcccaggcaggca

SEQ ID NO: 52820 - DNA, 20 bp, Artificial sequence
  synthetic polynucleotide sequence
gccggtgggggcaacacaca

SEQ ID NO: 52821 - DNA, 23 bp, Artificial sequence
  synthetic polynucleotide sequence
ctccccacaaaggaaaatctcca

SEQ ID NO: 52822 - DNA, 20 bp, Artificial sequence
  synthetic polynucleotide sequence
tccgagctgggcaggatgca

SEQ ID NO: 52823 - DNA, 22 bp, Artificial sequence
  synthetic polynucleotide sequence
gctctgccaaagccctgcagaa

SEQ ID NO: 52824 - DNA, 23 bp, Artificial sequence
  synthetic polynucleotide sequence
gagaccaaggaaccacggtcaca

SEQ ID NO: 52825 - DNA, 20 bp, Artificial sequence
  synthetic polynucleotide sequence
cctgcaaagagcccagcaca

SEQ ID NO: 52826 - DNA, 20 bp, Artificial sequence
  synthetic polynucleotide sequence
tggcaacggcaacggtgaga

SEQ ID NO: 52827 - DNA, 20 bp, Artificial sequence
  synthetic polynucleotide sequence
tgccggcgccagagatccaa

SEQ ID NO: 52828 - DNA, 20 bp, Artificial sequence
  synthetic polynucleotide sequence
caggtcagcagcagccccca

SEQ ID NO: 52829 - DNA, 20 bp, Artificial sequence
  synthetic polynucleotide sequence
cccatggcaggcggcctaga

SEQ ID NO: 52830 - DNA, 19 bp, Artificial sequence
  synthetic polynucleotide sequence
ctgtcatggcccgccccca

SEQ ID NO: 52831 - DNA, 20 bp, Artificial sequence
  synthetic polynucleotide sequence
gccatccgcactggcaacga

SEQ ID NO: 52832 - DNA, 25 bp, Artificial sequence
  synthetic polynucleotide sequence
agggaagaatgccagagtcactaca

SEQ ID NO: 52833 - DNA, 21 bp, Artificial sequence
  synthetic polynucleotide sequence
aatggactgcggtcaacccaa

SEQ ID NO: 52834 - DNA, 20 bp, Artificial sequence
  synthetic polynucleotide sequence
accctccggatccagtggaa

SEQ ID NO: 52835 - DNA, 21 bp, Artificial sequence
  synthetic polynucleotide sequence
tacacccccaccactttcaca

SEQ ID NO: 52836 - DNA, 20 bp, Artificial sequence
  synthetic polynucleotide sequence
gctgaggtcaacagggggaa

SEQ ID NO: 52837 - DNA, 20 bp, Artificial sequence
  synthetic polynucleotide sequence
taaccagcgcctcccaagca

SEQ ID NO: 52838 - DNA, 20 bp, Artificial sequence
  synthetic polynucleotide sequence
gagacccttgaaggcaggga

SEQ ID NO: 52839 - DNA, 18 bp, Artificial sequence
  synthetic polynucleotide sequence
gcagccgccgcttcgcca

SEQ ID NO: 52840 - DNA, 20 bp, Artificial sequence
  synthetic polynucleotide sequence
cgtggtcaccgtgacaagga

SEQ ID NO: 52841 - DNA, 20 bp, Artificial sequence
  synthetic polynucleotide sequence
agggagctgccccacctgga

SEQ ID NO: 52842 - DNA, 18 bp, Artificial sequence
  synthetic polynucleotide sequence
ggaggccgggctggccca

SEQ ID NO: 52843 - DNA, 25 bp, Artificial sequence
  synthetic polynucleotide sequence
acaggtagagccacctagaaatgca

SEQ ID NO: 52844 - DNA, 25 bp, Artificial sequence
  synthetic polynucleotide sequence
tcagcacaaaaagcaccctagccca

SEQ ID NO: 52845 - DNA, 20 bp, Artificial sequence
  synthetic polynucleotide sequence
cagctgctgacagccctgga

SEQ ID NO: 52846 - DNA, 21 bp, Artificial sequence
  synthetic polynucleotide sequence
tgagggtgtcaaagccagaga

SEQ ID NO: 52847 - DNA, 18 bp, Artificial sequence
  synthetic polynucleotide sequence
ggcacccgccctgggcca

SEQ ID NO: 52848 - DNA, 20 bp, Artificial sequence
  synthetic polynucleotide sequence
gggggaagccacctaaccca

SEQ ID NO: 52849 - DNA, 20 bp, Artificial sequence
  synthetic polynucleotide sequence
gagctgctgcctgaagggga

SEQ ID NO: 52850 - DNA, 20 bp, Artificial sequence
  synthetic polynucleotide sequence
ttggagaagggggctccaga

SEQ ID NO: 52851 - DNA, 19 bp, Artificial sequence
  synthetic polynucleotide sequence
ccagccccggggtctcaga

SEQ ID NO: 52852 - DNA, 20 bp, Artificial sequence
  synthetic polynucleotide sequence
gctcctgggggtgagaccca

SEQ ID NO: 52853 - DNA, 20 bp, Artificial sequence
  synthetic polynucleotide sequence
tgccagcccagctgctgcca

SEQ ID NO: 52854 - DNA, 18 bp, Artificial sequence
  synthetic polynucleotide sequence
ccctgggggacgtgccca

SEQ ID NO: 52855 - DNA, 20 bp, Artificial sequence
  synthetic polynucleotide sequence
ttgggccgacagcccgggaa

SEQ ID NO: 52856 - DNA, 20 bp, Artificial sequence
  synthetic polynucleotide sequence
ggactgtcccctggcaccca

SEQ ID NO: 52857 - DNA, 23 bp, Artificial sequence
  synthetic polynucleotide sequence
catcacttcaaaagagcccccaa

SEQ ID NO: 52858 - DNA, 20 bp, Artificial sequence
  synthetic polynucleotide sequence
gggtgggcctccataggcca

SEQ ID NO: 52859 - DNA, 22 bp, Artificial sequence
  synthetic polynucleotide sequence
acctaaggctgaaccagtcaga

SEQ ID NO: 52860 - DNA, 20 bp, Artificial sequence
  synthetic polynucleotide sequence
gtggaaccgaggggcctgga

SEQ ID NO: 52861 - DNA, 20 bp, Artificial sequence
  synthetic polynucleotide sequence
cactgccacagggacagcca

SEQ ID NO: 52862 - DNA, 20 bp, Artificial sequence
  synthetic polynucleotide sequence
tcacagggagacccctccaa

SEQ ID NO: 52863 - DNA, 22 bp, Artificial sequence
  synthetic polynucleotide sequence
aggaaaccaagactgctgcgga

SEQ ID NO: 52864 - DNA, 21 bp, Artificial sequence
  synthetic polynucleotide sequence
cctgaggtggtgagaagacca

SEQ ID NO: 52865 - DNA, 20 bp, Artificial sequence
  synthetic polynucleotide sequence
gaaggtcacctgagcctgga

SEQ ID NO: 52866 - DNA, 22 bp, Artificial sequence
  synthetic polynucleotide sequence
gaagagacaggaactgcggaga

SEQ ID NO: 52867 - DNA, 20 bp, Artificial sequence
  synthetic polynucleotide sequence
cttcagggtcgagggcagga

SEQ ID NO: 52868 - DNA, 20 bp, Artificial sequence
  synthetic polynucleotide sequence
cccaccacctcccgctggaa

SEQ ID NO: 52869 - DNA, 22 bp, Artificial sequence
  synthetic polynucleotide sequence
gaaggcagtgaccaaggaggaa

SEQ ID NO: 52870 - DNA, 20 bp, Artificial sequence
  synthetic polynucleotide sequence
cagtggcctgagcagtggga

SEQ ID NO: 52871 - DNA, 25 bp, Artificial sequence
  synthetic polynucleotide sequence
caggccccacaaaagttggatccaa

SEQ ID NO: 52872 - DNA, 20 bp, Artificial sequence
  synthetic polynucleotide sequence
ggaacctgagctccacagga

SEQ ID NO: 52873 - DNA, 21 bp, Artificial sequence
  synthetic polynucleotide sequence
tcacaggcttcacagggcaga

SEQ ID NO: 52874 - DNA, 21 bp, Artificial sequence
  synthetic polynucleotide sequence
cagggcacatacaggctgtca

SEQ ID NO: 52875 - DNA, 20 bp, Artificial sequence
  synthetic polynucleotide sequence
ctgcgtacacagctggcaca

SEQ ID NO: 52876 - DNA, 25 bp, Artificial sequence
  synthetic polynucleotide sequence
aaactgtggaatcacactggagcca

SEQ ID NO: 52877 - DNA, 20 bp, Artificial sequence
  synthetic polynucleotide sequence
ggaatggccctggtaccaca

SEQ ID NO: 52878 - DNA, 20 bp, Artificial sequence
  synthetic polynucleotide sequence
gaggacacactcaagcccca

SEQ ID NO: 52879 - DNA, 20 bp, Artificial sequence
  synthetic polynucleotide sequence
cacggcctggtaccggcgga

SEQ ID NO: 52880 - DNA, 22 bp, Artificial sequence
  synthetic polynucleotide sequence
aaagcagtgagcccaacacaga

SEQ ID NO: 52881 - DNA, 25 bp, Artificial sequence
  synthetic polynucleotide sequence
cagagcagaggatattacgcaggaa

SEQ ID NO: 52882 - DNA, 24 bp, Artificial sequence
  synthetic polynucleotide sequence
gagttgccaggattacacaaacca

SEQ ID NO: 52883 - DNA, 21 bp, Artificial sequence
  synthetic polynucleotide sequence
agtctgggcaagatagcgaga

SEQ ID NO: 52884 - DNA, 20 bp, Artificial sequence
  synthetic polynucleotide sequence
ggcatagacctgacccagga

SEQ ID NO: 52885 - DNA, 20 bp, Artificial sequence
  synthetic polynucleotide sequence
gaggcccaaatccgttccca

SEQ ID NO: 52886 - DNA, 21 bp, Artificial sequence
  synthetic polynucleotide sequence
ccaggtagtgagagaggagca

SEQ ID NO: 52887 - DNA, 20 bp, Artificial sequence
  synthetic polynucleotide sequence
tgcagcgtggtgccaccaca

SEQ ID NO: 52888 - DNA, 20 bp, Artificial sequence
  synthetic polynucleotide sequence
gagcgcggcagaggggagca

SEQ ID NO: 52889 - DNA, 20 bp, Artificial sequence
  synthetic polynucleotide sequence
gcctcaaagagccggcccga

SEQ ID NO: 52890 - DNA, 20 bp, Artificial sequence
  synthetic polynucleotide sequence
agcgcgtcctgtagagccga

SEQ ID NO: 52891 - DNA, 21 bp, Artificial sequence
  synthetic polynucleotide sequence
gccatgggagcaagatgtcca

SEQ ID NO: 52892 - DNA, 23 bp, Artificial sequence
  synthetic polynucleotide sequence
gtagaagctccaattaaccagca

SEQ ID NO: 52893 - DNA, 20 bp, Artificial sequence
  synthetic polynucleotide sequence
cgcctgggtctaaggaccca

SEQ ID NO: 52894 - DNA, 20 bp, Artificial sequence
  synthetic polynucleotide sequence
gcgcccctgaagatgtgaga

SEQ ID NO: 52895 - DNA, 19 bp, Artificial sequence
  synthetic polynucleotide sequence
cgcaacctcgccgtggcca

SEQ ID NO: 52896 - DNA, 23 bp, Artificial sequence
  synthetic polynucleotide sequence
gtgtctccaaggagggaggtaga

SEQ ID NO: 52897 - DNA, 25 bp, Artificial sequence
  synthetic polynucleotide sequence
actctcaaggaaccctgagtagaca

SEQ ID NO: 52898 - DNA, 21 bp, Artificial sequence
  synthetic polynucleotide sequence
ccagaaagtgtgagccctcca

SEQ ID NO: 52899 - DNA, 20 bp, Artificial sequence
  synthetic polynucleotide sequence
gaatatctgccgcccgagga

SEQ ID NO: 52900 - DNA, 20 bp, Artificial sequence
  synthetic polynucleotide sequence
cccacatgtggtcacaggca

SEQ ID NO: 52901 - DNA, 20 bp, Artificial sequence
  synthetic polynucleotide sequence
agccccaggaagttgaggca

SEQ ID NO: 52902 - DNA, 20 bp, Artificial sequence
  synthetic polynucleotide sequence
cacaggatccctgtggggca

SEQ ID NO: 52903 - DNA, 22 bp, Artificial sequence
  synthetic polynucleotide sequence
cagaactgcaggtcagagcaga

SEQ ID NO: 52904 - DNA, 20 bp, Artificial sequence
  synthetic polynucleotide sequence
cactttgcaggagggagcca

SEQ ID NO: 52905 - DNA, 19 bp, Artificial sequence
  synthetic polynucleotide sequence
ggaccccggccaagctgga

SEQ ID NO: 52906 - DNA, 19 bp, Artificial sequence
  synthetic polynucleotide sequence
cagagccgggctgggcgca

SEQ ID NO: 52907 - DNA, 22 bp, Artificial sequence
  synthetic polynucleotide sequence
gtaggacggcaacacacaacca

SEQ ID NO: 52908 - DNA, 21 bp, Artificial sequence
  synthetic polynucleotide sequence
ctgaaactcacaggtgcggga

SEQ ID NO: 52909 - DNA, 20 bp, Artificial sequence
  synthetic polynucleotide sequence
gcgcacctcggcccaatgca

SEQ ID NO: 52910 - DNA, 20 bp, Artificial sequence
  synthetic polynucleotide sequence
ggcaggcaaccaatgaggca

SEQ ID NO: 52911 - DNA, 25 bp, Artificial sequence
  synthetic polynucleotide sequence
attgtccaacaaccacccaccaaca

SEQ ID NO: 52912 - DNA, 20 bp, Artificial sequence
  synthetic polynucleotide sequence
ctgggccagggttgagagga

SEQ ID NO: 52913 - DNA, 19 bp, Artificial sequence
  synthetic polynucleotide sequence
cggcctggttggggcagga

SEQ ID NO: 52914 - DNA, 25 bp, Artificial sequence
  synthetic polynucleotide sequence
gtggtcaaagaggaagtgcatcaga

SEQ ID NO: 52915 - DNA, 21 bp, Artificial sequence
  synthetic polynucleotide sequence
tccgggaagctcacaagtaca

SEQ ID NO: 52916 - DNA, 24 bp, Artificial sequence
  synthetic polynucleotide sequence
aagttgatccagacatagaggcca

SEQ ID NO: 52917 - DNA, 20 bp, Artificial sequence
  synthetic polynucleotide sequence
gccagaaagccccgagggca

SEQ ID NO: 52918 - DNA, 20 bp, Artificial sequence
  synthetic polynucleotide sequence
gctcggtcagcacgaaggga

SEQ ID NO: 52919 - DNA, 20 bp, Artificial sequence
  synthetic polynucleotide sequence
gaggcgcagagcctttcaga

SEQ ID NO: 52920 - DNA, 20 bp, Artificial sequence
  synthetic polynucleotide sequence
gttgagaaggggcgtcagca

SEQ ID NO: 52921 - DNA, 22 bp, Artificial sequence
  synthetic polynucleotide sequence
cgcgctatgccatccagcagaa

SEQ ID NO: 52922 - DNA, 21 bp, Artificial sequence
  synthetic polynucleotide sequence
gaaggagcagttgccagtgca

SEQ ID NO: 52923 - DNA, 22 bp, Artificial sequence
  synthetic polynucleotide sequence
gctctgaaacatcccggcagaa

SEQ ID NO: 52924 - DNA, 22 bp, Artificial sequence
  synthetic polynucleotide sequence
gactctcaatgacagagcagca

SEQ ID NO: 52925 - DNA, 20 bp, Artificial sequence
  synthetic polynucleotide sequence
aggatgagagcccacctgga

SEQ ID NO: 52926 - DNA, 20 bp, Artificial sequence
  synthetic polynucleotide sequence
cagccaggttccctcacaca

SEQ ID NO: 52927 - DNA, 23 bp, Artificial sequence
  synthetic polynucleotide sequence
cttcaatcacagcccaccacaca

SEQ ID NO: 52928 - DNA, 20 bp, Artificial sequence
  synthetic polynucleotide sequence
gagggacagttggctgagga

SEQ ID NO: 52929 - DNA, 20 bp, Artificial sequence
  synthetic polynucleotide sequence
cagggcgctgagcgggtcca

SEQ ID NO: 52930 - DNA, 19 bp, Artificial sequence
  synthetic polynucleotide sequence
gcggtgcccactacgccga

SEQ ID NO: 52931 - DNA, 20 bp, Artificial sequence
  synthetic polynucleotide sequence
atcggccacgcgcaccccaa

SEQ ID NO: 52932 - DNA, 20 bp, Artificial sequence
  synthetic polynucleotide sequence
ggcgagtgggcgtcagagca

SEQ ID NO: 52933 - DNA, 20 bp, Artificial sequence
  synthetic polynucleotide sequence
gatcaccgccgccctgagca

SEQ ID NO: 52934 - DNA, 20 bp, Artificial sequence
  synthetic polynucleotide sequence
ggtacgggcctgccatcaga

SEQ ID NO: 52935 - DNA, 21 bp, Artificial sequence
  synthetic polynucleotide sequence
gcaccttccagaccatgacca

SEQ ID NO: 52936 - DNA, 20 bp, Artificial sequence
  synthetic polynucleotide sequence
tggagcagaaagggagggca

SEQ ID NO: 52937 - DNA, 22 bp, Artificial sequence
  synthetic polynucleotide sequence
acagtacaggatggagccagga

SEQ ID NO: 52938 - DNA, 21 bp, Artificial sequence
  synthetic polynucleotide sequence
agactaagcacctgtgaggca

SEQ ID NO: 52939 - DNA, 20 bp, Artificial sequence
  synthetic polynucleotide sequence
agcaggtgagcagagtgcca

SEQ ID NO: 52940 - DNA, 20 bp, Artificial sequence
  synthetic polynucleotide sequence
tggggagtgtccccccaaga

SEQ ID NO: 52941 - DNA, 22 bp, Artificial sequence
  synthetic polynucleotide sequence
aagacctaccaaccatgtagga

SEQ ID NO: 52942 - DNA, 21 bp, Artificial sequence
  synthetic polynucleotide sequence
taaaggggttcccacagcaga

SEQ ID NO: 52943 - DNA, 25 bp, Artificial sequence
  synthetic polynucleotide sequence
ccagtccatacccaaagtgatggaa

SEQ ID NO: 52944 - DNA, 23 bp, Artificial sequence
  synthetic polynucleotide sequence
gggggagaaaacaatgctctgca

SEQ ID NO: 52945 - DNA, 20 bp, Artificial sequence
  synthetic polynucleotide sequence
tggggtgacaggggcagaga

SEQ ID NO: 52946 - DNA, 25 bp, Artificial sequence
  synthetic polynucleotide sequence
ttgggggaacctacagacagaagca

SEQ ID NO: 52947 - DNA, 20 bp, Artificial sequence
  synthetic polynucleotide sequence
aagctccccaagggccaaga

SEQ ID NO: 52948 - DNA, 20 bp, Artificial sequence
  synthetic polynucleotide sequence
gccaggcaccattctgggca

SEQ ID NO: 52949 - DNA, 20 bp, Artificial sequence
  synthetic polynucleotide sequence
acctggaagccccctcccca

SEQ ID NO: 52950 - DNA, 20 bp, Artificial sequence
  synthetic polynucleotide sequence
gccgtgacacagcctcagga

SEQ ID NO: 52951 - DNA, 22 bp, Artificial sequence
  synthetic polynucleotide sequence
gaaaacataacagcagggggca

SEQ ID NO: 52952 - DNA, 20 bp, Artificial sequence
  synthetic polynucleotide sequence
gtaggacacgggtccctgaa

SEQ ID NO: 52953 - DNA, 20 bp, Artificial sequence
  synthetic polynucleotide sequence
cccacctgggtccacatgca

SEQ ID NO: 52954 - DNA, 20 bp, Artificial sequence
  synthetic polynucleotide sequence
tcacgtggggggaacagaca

SEQ ID NO: 52955 - DNA, 20 bp, Artificial sequence
  synthetic polynucleotide sequence
aactgacaacccccctccca

SEQ ID NO: 52956 - DNA, 21 bp, Artificial sequence
  synthetic polynucleotide sequence
tccactacctcagagagacca

SEQ ID NO: 52957 - DNA, 20 bp, Artificial sequence
  synthetic polynucleotide sequence
agctcacagggcttccagga

SEQ ID NO: 52958 - DNA, 22 bp, Artificial sequence
  synthetic polynucleotide sequence
ctcccaatgctccgataagcaa

SEQ ID NO: 52959 - DNA, 22 bp, Artificial sequence
  synthetic polynucleotide sequence
aaaatcctgcacctggaacaga

SEQ ID NO: 52960 - DNA, 21 bp, Artificial sequence
  synthetic polynucleotide sequence
aagaccgatcgaatgaggcca

SEQ ID NO: 52961 - DNA, 20 bp, Artificial sequence
  synthetic polynucleotide sequence
agcccctccagcttcaggga

SEQ ID NO: 52962 - DNA, 20 bp, Artificial sequence
  synthetic polynucleotide sequence
agcagacatgccccacccca

SEQ ID NO: 52963 - DNA, 25 bp, Artificial sequence
  synthetic polynucleotide sequence
gaagcagtagaagccggtgatgcaa

SEQ ID NO: 52964 - DNA, 22 bp, Artificial sequence
  synthetic polynucleotide sequence
tgcatatacccccaagcaggca

SEQ ID NO: 52965 - DNA, 25 bp, Artificial sequence
  synthetic polynucleotide sequence
ccactggaaattcctgcaagagcaa

SEQ ID NO: 52966 - DNA, 20 bp, Artificial sequence
  synthetic polynucleotide sequence
cacaagtgcgttgggaggca

SEQ ID NO: 52967 - DNA, 20 bp, Artificial sequence
  synthetic polynucleotide sequence
aaccccttcccctgccacca

SEQ ID NO: 52968 - DNA, 22 bp, Artificial sequence
  synthetic polynucleotide sequence
cacattactgcaggaggaggaa

SEQ ID NO: 52969 - DNA, 23 bp, Artificial sequence
  synthetic polynucleotide sequence
gccagagtaaccagacggcacaa

SEQ ID NO: 52970 - DNA, 20 bp, Artificial sequence
  synthetic polynucleotide sequence
gagggagtgggggtggggga

SEQ ID NO: 52971 - DNA, 19 bp, Artificial sequence
  synthetic polynucleotide sequence
caggggcagggagtgggga

SEQ ID NO: 52972 - DNA, 23 bp, Artificial sequence
  synthetic polynucleotide sequence
cacaactgcagagcatcgtcaga

SEQ ID NO: 52973 - DNA, 22 bp, Artificial sequence
  synthetic polynucleotide sequence
tccacaggatgaactcagcaga

SEQ ID NO: 52974 - DNA, 20 bp, Artificial sequence
  synthetic polynucleotide sequence
ggcagccccatagaagagga

SEQ ID NO: 52975 - DNA, 18 bp, Artificial sequence
  synthetic polynucleotide sequence
gactgctgagcagcggca

SEQ ID NO: 52976 - DNA, 18 bp, Artificial sequence
  synthetic polynucleotide sequence
ccagggatcctgggcgca

SEQ ID NO: 52977 - DNA, 20 bp, Artificial sequence
  synthetic polynucleotide sequence
ggcctgcacagacactcaca

SEQ ID NO: 52978 - DNA, 22 bp, Artificial sequence
  synthetic polynucleotide sequence
tagggagcacaagatgatgaca

SEQ ID NO: 52979 - DNA, 20 bp, Artificial sequence
  synthetic polynucleotide sequence
gaggctgagaatggcgtgca

SEQ ID NO: 52980 - DNA, 20 bp, Artificial sequence
  synthetic polynucleotide sequence
gctggagtgcagtggcgcaa

SEQ ID NO: 52981 - DNA, 22 bp, Artificial sequence
  synthetic polynucleotide sequence
ctgatggccagacatatggcaa

SEQ ID NO: 52982 - DNA, 22 bp, Artificial sequence
  synthetic polynucleotide sequence
tgcaaaagctggcaagtcacca

SEQ ID NO: 52983 - DNA, 20 bp, Artificial sequence
  synthetic polynucleotide sequence
cctcctgctcccagaggcga

SEQ ID NO: 52984 - DNA, 20 bp, Artificial sequence
  synthetic polynucleotide sequence
tgggcagcacgttaggggca

SEQ ID NO: 52985 - DNA, 20 bp, Artificial sequence
  synthetic polynucleotide sequence
gctggggaagcagaagcaga

SEQ ID NO: 52986 - DNA, 21 bp, Artificial sequence
  synthetic polynucleotide sequence
cagaaggaagaaaggccccca

SEQ ID NO: 52987 - DNA, 19 bp, Artificial sequence
  synthetic polynucleotide sequence
gaccccctccccatgctca

SEQ ID NO: 52988 - DNA, 18 bp, Artificial sequence
  synthetic polynucleotide sequence
ggagcccaggcgcttcca

SEQ ID NO: 52989 - DNA, 22 bp, Artificial sequence
  synthetic polynucleotide sequence
gaatgctcaggtatccaccgca

SEQ ID NO: 52990 - DNA, 20 bp, Artificial sequence
  synthetic polynucleotide sequence
cccagggacagctcagtgca

SEQ ID NO: 52991 - DNA, 23 bp, Artificial sequence
  synthetic polynucleotide sequence
gttctcacagactcctgaaggaa

SEQ ID NO: 52992 - DNA, 20 bp, Artificial sequence
  synthetic polynucleotide sequence
tcctcagcagacctagggga

SEQ ID NO: 52993 - DNA, 21 bp, Artificial sequence
  synthetic polynucleotide sequence
gcaggggtaaacatggtccca

SEQ ID NO: 52994 - DNA, 20 bp, Artificial sequence
  synthetic polynucleotide sequence
gctccacccactgtcccaga

SEQ ID NO: 52995 - DNA, 22 bp, Artificial sequence
  synthetic polynucleotide sequence
tgaagcctagcagctatgagga

SEQ ID NO: 52996 - DNA, 20 bp, Artificial sequence
  synthetic polynucleotide sequence
acgcgtcgagcacttgccga

SEQ ID NO: 52997 - DNA, 20 bp, Artificial sequence
  synthetic polynucleotide sequence
aaagcacgcctgccactgga

SEQ ID NO: 52998 - DNA, 19 bp, Artificial sequence
  synthetic polynucleotide sequence
tccgcttcatggcagagga

SEQ ID NO: 52999 - DNA, 25 bp, Artificial sequence
  synthetic polynucleotide sequence
gtcaccaactgcggaaacaatgaca

SEQ ID NO: 53000 - DNA, 25 bp, Artificial sequence
  synthetic polynucleotide sequence
ttcacaggcaagccagaactcaaca

SEQ ID NO: 53001 - DNA, 20 bp, Artificial sequence
  synthetic polynucleotide sequence
accccacaaggccaggccga

SEQ ID NO: 53002 - DNA, 20 bp, Artificial sequence
  synthetic polynucleotide sequence
gggccacaggagaacaggca

SEQ ID NO: 53003 - DNA, 25 bp, Artificial sequence
  synthetic polynucleotide sequence
actaccagaaggccaatgacctgaa

SEQ ID NO: 53004 - DNA, 21 bp, Artificial sequence
  synthetic polynucleotide sequence
tagtaccttgggacccaggaa

SEQ ID NO: 53005 - DNA, 21 bp, Artificial sequence
  synthetic polynucleotide sequence
ggggagactgaagagccacca

SEQ ID NO: 53006 - DNA, 20 bp, Artificial sequence
  synthetic polynucleotide sequence
gcagcagcagtgggcgacga

SEQ ID NO: 53007 - DNA, 20 bp, Artificial sequence
  synthetic polynucleotide sequence
gaggaaaggccctagggaga

SEQ ID NO: 53008 - DNA, 21 bp, Artificial sequence
  synthetic polynucleotide sequence
tgacagtcccaacactctgca

SEQ ID NO: 53009 - DNA, 25 bp, Artificial sequence
  synthetic polynucleotide sequence
acccagagttaccacaggaagacaa

SEQ ID NO: 53010 - DNA, 20 bp, Artificial sequence
  synthetic polynucleotide sequence
ctcccaccagcttggagaca

SEQ ID NO: 53011 - DNA, 20 bp, Artificial sequence
  synthetic polynucleotide sequence
agaggcatcgcctgtggaca

SEQ ID NO: 53012 - DNA, 25 bp, Artificial sequence
  synthetic polynucleotide sequence
aaagccacctacgatataccaccca

SEQ ID NO: 53013 - DNA, 20 bp, Artificial sequence
  synthetic polynucleotide sequence
gcctggctggggagaagaca

SEQ ID NO: 53014 - DNA, 23 bp, Artificial sequence
  synthetic polynucleotide sequence
caaaaaggccacagtgtgatgca

SEQ ID NO: 53015 - DNA, 20 bp, Artificial sequence
  synthetic polynucleotide sequence
aggcaggaggagaggaacca

SEQ ID NO: 53016 - DNA, 18 bp, Artificial sequence
  synthetic polynucleotide sequence
cccacccccctcccccca

SEQ ID NO: 53017 - DNA, 25 bp, Artificial sequence
  synthetic polynucleotide sequence
aaagtgtccggtgcaacaatgagca

SEQ ID NO: 53018 - DNA, 19 bp, Artificial sequence
  synthetic polynucleotide sequence
cggccggtgctgaggggga

SEQ ID NO: 53019 - DNA, 20 bp, Artificial sequence
  synthetic polynucleotide sequence
gaagccatggcctcctgaga

SEQ ID NO: 53020 - DNA, 23 bp, Artificial sequence
  synthetic polynucleotide sequence
gtgcagctacaaaagggcagcca

SEQ ID NO: 53021 - DNA, 20 bp, Artificial sequence
  synthetic polynucleotide sequence
ccggaagcaggcctggcaga

SEQ ID NO: 53022 - DNA, 19 bp, Artificial sequence
  synthetic polynucleotide sequence
gcgcgagcaggggaaggca

SEQ ID NO: 53023 - DNA, 22 bp, Artificial sequence
  synthetic polynucleotide sequence
gtaggacggcaacacacaacca

SEQ ID NO: 53024 - DNA, 21 bp, Artificial sequence
  synthetic polynucleotide sequence
ctgaaactcacaggtgcggga

SEQ ID NO: 53025 - DNA, 20 bp, Artificial sequence
  synthetic polynucleotide sequence
ggcctggcaggatgactcaa

SEQ ID NO: 53026 - DNA, 20 bp, Artificial sequence
  synthetic polynucleotide sequence
gcaaccccatccaggcagga

SEQ ID NO: 53027 - DNA, 20 bp, Artificial sequence
  synthetic polynucleotide sequence
gtgtgggcacagcagatcca

SEQ ID NO: 53028 - DNA, 20 bp, Artificial sequence
  synthetic polynucleotide sequence
aagccagctctcagcaggga

SEQ ID NO: 53029 - DNA, 20 bp, Artificial sequence
  synthetic polynucleotide sequence
agagtgaacgcgggtgggaa

SEQ ID NO: 53030 - DNA, 25 bp, Artificial sequence
  synthetic polynucleotide sequence
cctgaagcaggcaacttcaaacaga

SEQ ID NO: 53031 - DNA, 23 bp, Artificial sequence
  synthetic polynucleotide sequence
gtaggatcacaataggccacgaa

SEQ ID NO: 53032 - DNA, 22 bp, Artificial sequence
  synthetic polynucleotide sequence
actacaggtaagtgccagcaca

SEQ ID NO: 53033 - DNA, 20 bp, Artificial sequence
  synthetic polynucleotide sequence
acggcgatctccagcaccaa

SEQ ID NO: 53034 - DNA, 21 bp, Artificial sequence
  synthetic polynucleotide sequence
agaagccgcaggatgtctaca

SEQ ID NO: 53035 - DNA, 20 bp, Artificial sequence
  synthetic polynucleotide sequence
gcagacctggaccgtggaca

SEQ ID NO: 53036 - DNA, 23 bp, Artificial sequence
  synthetic polynucleotide sequence
ccaacccagcaatacaggaagga

SEQ ID NO: 53037 - DNA, 21 bp, Artificial sequence
  synthetic polynucleotide sequence
cctgcatgccgaataccgaca

SEQ ID NO: 53038 - DNA, 20 bp, Artificial sequence
  synthetic polynucleotide sequence
cctggggcagatccaacaca

SEQ ID NO: 53039 - DNA, 20 bp, Artificial sequence
  synthetic polynucleotide sequence
agcagtgactcgactgggca

SEQ ID NO: 53040 - DNA, 20 bp, Artificial sequence
  synthetic polynucleotide sequence
cacatagcggcccaggtcca

SEQ ID NO: 53041 - DNA, 20 bp, Artificial sequence
  synthetic polynucleotide sequence
ccccccgaaactccttggaa

SEQ ID NO: 53042 - DNA, 23 bp, Artificial sequence
  synthetic polynucleotide sequence
gaacacatgccatactgccagca

SEQ ID NO: 53043 - DNA, 20 bp, Artificial sequence
  synthetic polynucleotide sequence
catccagccatgtgggagca

SEQ ID NO: 53044 - DNA, 20 bp, Artificial sequence
  synthetic polynucleotide sequence
gtctgcctacagcagaggca

SEQ ID NO: 53045 - DNA, 20 bp, Artificial sequence
  synthetic polynucleotide sequence
ggcctcacagatcgtcagga

SEQ ID NO: 53046 - DNA, 23 bp, Artificial sequence
  synthetic polynucleotide sequence
gatcaaacccaagttgcctacca

SEQ ID NO: 53047 - DNA, 20 bp, Artificial sequence
  synthetic polynucleotide sequence
aagctggcctgtggcgagaa

SEQ ID NO: 53048 - DNA, 20 bp, Artificial sequence
  synthetic polynucleotide sequence
gtgggaggagcatgtggaga

SEQ ID NO: 53049 - DNA, 22 bp, Artificial sequence
  synthetic polynucleotide sequence
cccacccactaagcactgtgca

SEQ ID NO: 53050 - DNA, 22 bp, Artificial sequence
  synthetic polynucleotide sequence
taaggaggcatcacacaaggaa

SEQ ID NO: 53051 - DNA, 20 bp, Artificial sequence
  synthetic polynucleotide sequence
ctcaggaccagtgggaccca

SEQ ID NO: 53052 - DNA, 21 bp, Artificial sequence
  synthetic polynucleotide sequence
gctcaagaggatccccaggaa

SEQ ID NO: 53053 - DNA, 20 bp, Artificial sequence
  synthetic polynucleotide sequence
tcagccggcctgaagtcgca

SEQ ID NO: 53054 - DNA, 22 bp, Artificial sequence
  synthetic polynucleotide sequence
caccagaaaaagcagggtagca

SEQ ID NO: 53055 - DNA, 20 bp, Artificial sequence
  synthetic polynucleotide sequence
agggcactctcagatgccca

SEQ ID NO: 53056 - DNA, 20 bp, Artificial sequence
  synthetic polynucleotide sequence
gtgcgtggccgtaggggcca

SEQ ID NO: 53057 - DNA, 20 bp, Artificial sequence
  synthetic polynucleotide sequence
cgtacagacaggcgccggca

SEQ ID NO: 53058 - DNA, 20 bp, Artificial sequence
  synthetic polynucleotide sequence
gccatcacacagtggccgga

SEQ ID NO: 53059 - DNA, 22 bp, Artificial sequence
  synthetic polynucleotide sequence
agcctgcagtacccataagaga

SEQ ID NO: 53060 - DNA, 20 bp, Artificial sequence
  synthetic polynucleotide sequence
acaggtggcctctcaccaga

SEQ ID NO: 53061 - DNA, 20 bp, Artificial sequence
  synthetic polynucleotide sequence
cccctagagcacggccagca

SEQ ID NO: 53062 - DNA, 20 bp, Artificial sequence
  synthetic polynucleotide sequence
ccagggccactgcagctgga

SEQ ID NO: 53063 - DNA, 20 bp, Artificial sequence
  synthetic polynucleotide sequence
gctgagtgcagagctgggca

SEQ ID NO: 53064 - DNA, 25 bp, Artificial sequence
  synthetic polynucleotide sequence
caaaccacaaagcggaactggaaga

SEQ ID NO: 53065 - DNA, 25 bp, Artificial sequence
  synthetic polynucleotide sequence
aatgccatcacccatgcagcagaga

SEQ ID NO: 53066 - DNA, 20 bp, Artificial sequence
  synthetic polynucleotide sequence
gacttgggaagggtgggcca

SEQ ID NO: 53067 - DNA, 20 bp, Artificial sequence
  synthetic polynucleotide sequence
gagagggaagggaaggtgga

SEQ ID NO: 53068 - DNA, 19 bp, Artificial sequence
  synthetic polynucleotide sequence
cccaacccccgggctccca

SEQ ID NO: 53069 - DNA, 25 bp, Artificial sequence
  synthetic polynucleotide sequence
agacattgcaggcctgaagaaagca

SEQ ID NO: 53070 - DNA, 20 bp, Artificial sequence
  synthetic polynucleotide sequence
catcagggccagcccctgga

SEQ ID NO: 53071 - DNA, 22 bp, Artificial sequence
  synthetic polynucleotide sequence
atgaaggtgatcacctggaaga

SEQ ID NO: 53072 - DNA, 22 bp, Artificial sequence
  synthetic polynucleotide sequence
tgcctcatcatccggcaaagca

SEQ ID NO: 53073 - DNA, 25 bp, Artificial sequence
  synthetic polynucleotide sequence
aaggggcccattcatgagaagagga

SEQ ID NO: 53074 - DNA, 23 bp, Artificial sequence
  synthetic polynucleotide sequence
cttggtggaaaataacctcgaga

SEQ ID NO: 53075 - DNA, 19 bp, Artificial sequence
  synthetic polynucleotide sequence
ccctcgtgggccgaacgga

SEQ ID NO: 53076 - DNA, 20 bp, Artificial sequence
  synthetic polynucleotide sequence
acgagagccgcggcgacgaa

SEQ ID NO: 53077 - DNA, 20 bp, Artificial sequence
  synthetic polynucleotide sequence
ggcctgacccgcttagacaa

SEQ ID NO: 53078 - DNA, 20 bp, Artificial sequence
  synthetic polynucleotide sequence
cccactgccccctcatccaa

SEQ ID NO: 53079 - DNA, 22 bp, Artificial sequence
  synthetic polynucleotide sequence
ggatcccgagtagagaacgcaa

SEQ ID NO: 53080 - DNA, 20 bp, Artificial sequence
  synthetic polynucleotide sequence
tcgttccgccgagcaggaga

SEQ ID NO: 53081 - DNA, 25 bp, Artificial sequence
  synthetic polynucleotide sequence
gaggcaagaaccccctatactggaa

SEQ ID NO: 53082 - DNA, 23 bp, Artificial sequence
  synthetic polynucleotide sequence
cttcccatacagaagagtagcga

SEQ ID NO: 53083 - DNA, 20 bp, Artificial sequence
  synthetic polynucleotide sequence
agctagcgtgggacctggaa

SEQ ID NO: 53084 - DNA, 19 bp, Artificial sequence
  synthetic polynucleotide sequence
gggcccaggcccactccca

SEQ ID NO: 53085 - DNA, 20 bp, Artificial sequence
  synthetic polynucleotide sequence
cctggatagcagagcagcca

SEQ ID NO: 53086 - DNA, 25 bp, Artificial sequence
  synthetic polynucleotide sequence
atggtcatgctaagggaagaaggga

SEQ ID NO: 53087 - DNA, 20 bp, Artificial sequence
  synthetic polynucleotide sequence
ggctcagtcggagtggccaa

SEQ ID NO: 53088 - DNA, 21 bp, Artificial sequence
  synthetic polynucleotide sequence
ttccacaactgctcaaggcca

SEQ ID NO: 53089 - DNA, 20 bp, Artificial sequence
  synthetic polynucleotide sequence
cacacacgtgggctgagcaa

SEQ ID NO: 53090 - DNA, 20 bp, Artificial sequence
  synthetic polynucleotide sequence
gccacaggtagggcaaggga

SEQ ID NO: 53091 - DNA, 20 bp, Artificial sequence
  synthetic polynucleotide sequence
cttaagggagcccgagagga

SEQ ID NO: 53092 - DNA, 22 bp, Artificial sequence
  synthetic polynucleotide sequence
aataggcaggcattcaacagca

SEQ ID NO: 53093 - DNA, 21 bp, Artificial sequence
  synthetic polynucleotide sequence
aaggggcttcggaaaagtgca

SEQ ID NO: 53094 - DNA, 20 bp, Artificial sequence
  synthetic polynucleotide sequence
cgagagcagggcagtcccga

SEQ ID NO: 53095 - DNA, 20 bp, Artificial sequence
  synthetic polynucleotide sequence
gtaccctgcctcccaacgca

SEQ ID NO: 53096 - DNA, 21 bp, Artificial sequence
  synthetic polynucleotide sequence
tcctcccttgcagagaagcga

SEQ ID NO: 53097 - DNA, 23 bp, Artificial sequence
  synthetic polynucleotide sequence
gttggacagatactggaggagaa

SEQ ID NO: 53098 - DNA, 21 bp, Artificial sequence
  synthetic polynucleotide sequence
gtggttgcagggaaacccaca

SEQ ID NO: 53099 - DNA, 20 bp, Artificial sequence
  synthetic polynucleotide sequence
gccagcttggcgggctgcaa

SEQ ID NO: 53100 - DNA, 23 bp, Artificial sequence
  synthetic polynucleotide sequence
gggaaaaggacaggaagtgggca

SEQ ID NO: 53101 - DNA, 20 bp, Artificial sequence
  synthetic polynucleotide sequence
cagcacgggcagctggtcaa

SEQ ID NO: 53102 - DNA, 20 bp, Artificial sequence
  synthetic polynucleotide sequence
cttgccccgcagccgcagca

SEQ ID NO: 53103 - DNA, 25 bp, Artificial sequence
  synthetic polynucleotide sequence
actggagagaagccctacaaatcca

SEQ ID NO: 53104 - DNA, 23 bp, Artificial sequence
  synthetic polynucleotide sequence
ctccagtggacttgaagaacgga

SEQ ID NO: 53105 - DNA, 21 bp, Artificial sequence
  synthetic polynucleotide sequence
gcaggcaggcagttctgaaca

SEQ ID NO: 53106 - DNA, 23 bp, Artificial sequence
  synthetic polynucleotide sequence
cttaccccactgcaaatagccaa

SEQ ID NO: 53107 - DNA, 22 bp, Artificial sequence
  synthetic polynucleotide sequence
cagaaggaagggagagagacaa

SEQ ID NO: 53108 - DNA, 21 bp, Artificial sequence
  synthetic polynucleotide sequence
ccacaggcatggcagaaagga

SEQ ID NO: 53109 - DNA, 20 bp, Artificial sequence
  synthetic polynucleotide sequence
tgcccgtgcacacagccaga

SEQ ID NO: 53110 - DNA, 20 bp, Artificial sequence
  synthetic polynucleotide sequence
gcctaggccattcgcagaca

SEQ ID NO: 53111 - DNA, 19 bp, Artificial sequence
  synthetic polynucleotide sequence
cagcgggagggggagcaga

SEQ ID NO: 53112 - DNA, 25 bp, Artificial sequence
  synthetic polynucleotide sequence
gaaactgtaaacagccaccacagga

SEQ ID NO: 53113 - DNA, 22 bp, Artificial sequence
  synthetic polynucleotide sequence
ccagcagctcctcgaagaagga

SEQ ID NO: 53114 - DNA, 20 bp, Artificial sequence
  synthetic polynucleotide sequence
aggtccccctcctcaacaga

SEQ ID NO: 53115 - DNA, 23 bp, Artificial sequence
  synthetic polynucleotide sequence
gtggtgggggttcaaacacacaa

SEQ ID NO: 53116 - DNA, 22 bp, Artificial sequence
  synthetic polynucleotide sequence
agcctattccaaaccagcgaga

SEQ ID NO: 53117 - DNA, 23 bp, Artificial sequence
  synthetic polynucleotide sequence
cttccagtcccagaacaaagcca

SEQ ID NO: 53118 - DNA, 22 bp, Artificial sequence
  synthetic polynucleotide sequence
acacaaggagaggagcaagaca

SEQ ID NO: 53119 - DNA, 18 bp, Artificial sequence
  synthetic polynucleotide sequence
tgaccagaggcgcagtga

SEQ ID NO: 53120 - DNA, 18 bp, Artificial sequence
  synthetic polynucleotide sequence
ttcgggtcacagcggtca

SEQ ID NO: 53121 - DNA, 20 bp, Artificial sequence
  synthetic polynucleotide sequence
cccagtattgcgggccagca

SEQ ID NO: 53122 - DNA, 20 bp, Artificial sequence
  synthetic polynucleotide sequence
aggctgaaggactcctggga

SEQ ID NO: 53123 - DNA, 23 bp, Artificial sequence
  synthetic polynucleotide sequence
gtacagagatgccaacaactgca

SEQ ID NO: 53124 - DNA, 23 bp, Artificial sequence
  synthetic polynucleotide sequence
catcaaagtcctcgacagtcaca

SEQ ID NO: 53125 - DNA, 18 bp, Artificial sequence
  synthetic polynucleotide sequence
ggtggggaccccagagga

SEQ ID NO: 53126 - DNA, 21 bp, Artificial sequence
  synthetic polynucleotide sequence
ttgtgcattggctgcaggcca

SEQ ID NO: 53127 - DNA, 25 bp, Artificial sequence
  synthetic polynucleotide sequence
cagctcagccttgaagaaaagggaa

SEQ ID NO: 53128 - DNA, 23 bp, Artificial sequence
  synthetic polynucleotide sequence
gaagataggatgcccatccagaa

SEQ ID NO: 53129 - DNA, 20 bp, Artificial sequence
  synthetic polynucleotide sequence
cacacaggcaggctgagcaa

SEQ ID NO: 53130 - DNA, 20 bp, Artificial sequence
  synthetic polynucleotide sequence
gacgtgccacagcaagggca

SEQ ID NO: 53131 - DNA, 20 bp, Artificial sequence
  synthetic polynucleotide sequence
ctgatcaagcaggggccgga

SEQ ID NO: 53132 - DNA, 21 bp, Artificial sequence
  synthetic polynucleotide sequence
ctacaggacacaggtccccaa

SEQ ID NO: 53133 - DNA, 20 bp, Artificial sequence
  synthetic polynucleotide sequence
gcgcatcccgcttgagccca

SEQ ID NO: 53134 - DNA, 20 bp, Artificial sequence
  synthetic polynucleotide sequence
aagggaccgaaagcccagga

SEQ ID NO: 53135 - DNA, 20 bp, Artificial sequence
  synthetic polynucleotide sequence
catcctggacccagtgcaca

SEQ ID NO: 53136 - DNA, 20 bp, Artificial sequence
  synthetic polynucleotide sequence
acactcgaggctgcccccaa

SEQ ID NO: 53137 - DNA, 25 bp, Artificial sequence
  synthetic polynucleotide sequence
acacccctgaagtggggaaatggaa

SEQ ID NO: 53138 - DNA, 20 bp, Artificial sequence
  synthetic polynucleotide sequence
tgctgggcagggtccaggca

SEQ ID NO: 53139 - DNA, 20 bp, Artificial sequence
  synthetic polynucleotide sequence
ggctcaccctgggagagaca

SEQ ID NO: 53140 - DNA, 20 bp, Artificial sequence
  synthetic polynucleotide sequence
gccaagagagacgaaggcca

SEQ ID NO: 53141 - DNA, 20 bp, Artificial sequence
  synthetic polynucleotide sequence
cccccagcagctgatgaaca

SEQ ID NO: 53142 - DNA, 21 bp, Artificial sequence
  synthetic polynucleotide sequence
ttttgagagagcaggcaggga

SEQ ID NO: 53143 - DNA, 21 bp, Artificial sequence
  synthetic polynucleotide sequence
atcacacccagatcgcatcca

SEQ ID NO: 53144 - DNA, 21 bp, Artificial sequence
  synthetic polynucleotide sequence
gcctggagcaatcagtagcca

SEQ ID NO: 53145 - DNA, 20 bp, Artificial sequence
  synthetic polynucleotide sequence
ccgccgagaaactgtgagca

SEQ ID NO: 53146 - DNA, 20 bp, Artificial sequence
  synthetic polynucleotide sequence
gctgccctgaggaagctgaa

SEQ ID NO: 53147 - DNA, 20 bp, Artificial sequence
  synthetic polynucleotide sequence
gcgcactcctgaggatgaga

SEQ ID NO: 53148 - DNA, 20 bp, Artificial sequence
  synthetic polynucleotide sequence
gtgagccgggccagaacgaa

SEQ ID NO: 53149 - DNA, 20 bp, Artificial sequence
  synthetic polynucleotide sequence
tgcgcaccacagggaggcaa

SEQ ID NO: 53150 - DNA, 20 bp, Artificial sequence
  synthetic polynucleotide sequence
gggttcaccgacgccagcca

SEQ ID NO: 53151 - DNA, 20 bp, Artificial sequence
  synthetic polynucleotide sequence
gggtgcacacagcaggtgca

SEQ ID NO: 53152 - DNA, 20 bp, Artificial sequence
  synthetic polynucleotide sequence
ggagaaagggacctcccaga

SEQ ID NO: 53153 - DNA, 21 bp, Artificial sequence
  synthetic polynucleotide sequence
gtgagtgccaagagaggacca

SEQ ID NO: 53154 - DNA, 21 bp, Artificial sequence
  synthetic polynucleotide sequence
acaaaggaacacacgtctgga

SEQ ID NO: 53155 - DNA, 20 bp, Artificial sequence
  synthetic polynucleotide sequence
cggagacagcccacaggcca

SEQ ID NO: 53156 - DNA, 25 bp, Artificial sequence
  synthetic polynucleotide sequence
tttacccaaggccacaacaacagca

SEQ ID NO: 53157 - DNA, 21 bp, Artificial sequence
  synthetic polynucleotide sequence
ggacctataggcgcctgaaga

SEQ ID NO: 53158 - DNA, 20 bp, Artificial sequence
  synthetic polynucleotide sequence
ccgactgatcactcccggca

SEQ ID NO: 53159 - DNA, 20 bp, Artificial sequence
  synthetic polynucleotide sequence
acagccgaacctgtcagcca

SEQ ID NO: 53160 - DNA, 21 bp, Artificial sequence
  synthetic polynucleotide sequence
ttctgaggacaaggcagagga

SEQ ID NO: 53161 - DNA, 20 bp, Artificial sequence
  synthetic polynucleotide sequence
aactgacccctcccctgcaa

SEQ ID NO: 53162 - DNA, 21 bp, Artificial sequence
  synthetic polynucleotide sequence
caccaacagtgcctcaggaga

SEQ ID NO: 53163 - DNA, 20 bp, Artificial sequence
  synthetic polynucleotide sequence
agagaggcctctccctggaa

SEQ ID NO: 53164 - DNA, 20 bp, Artificial sequence
  synthetic polynucleotide sequence
ctggagaggagggggctcaa

SEQ ID NO: 53165 - DNA, 20 bp, Artificial sequence
  synthetic polynucleotide sequence
atggggagggcaggaaggga

SEQ ID NO: 53166 - DNA, 20 bp, Artificial sequence
  synthetic polynucleotide sequence
cacacgaggcccccaacgca

SEQ ID NO: 53167 - DNA, 20 bp, Artificial sequence
  synthetic polynucleotide sequence
tttgagaggccgggacagga

SEQ ID NO: 53168 - DNA, 20 bp, Artificial sequence
  synthetic polynucleotide sequence
actgcagcctcacactccca

SEQ ID NO: 53169 - DNA, 22 bp, Artificial sequence
  synthetic polynucleotide sequence
ctgggacccactaactcctcaa

SEQ ID NO: 53170 - DNA, 20 bp, Artificial sequence
  synthetic polynucleotide sequence
cccagccagaaactgggcca

SEQ ID NO: 53171 - DNA, 20 bp, Artificial sequence
  synthetic polynucleotide sequence
gtggaacctgggcctcccga

SEQ ID NO: 53172 - DNA, 25 bp, Artificial sequence
  synthetic polynucleotide sequence
aaccatcctcgcgtaaaacgaagca

SEQ ID NO: 53173 - DNA, 20 bp, Artificial sequence
  synthetic polynucleotide sequence
ctgcccacagtgtcgggcaa

SEQ ID NO: 53174 - DNA, 20 bp, Artificial sequence
  synthetic polynucleotide sequence
aagaccgtgccaagtgggga

SEQ ID NO: 53175 - DNA, 19 bp, Artificial sequence
  synthetic polynucleotide sequence
gctcccgcctcagtgcgca

SEQ ID NO: 53176 - DNA, 23 bp, Artificial sequence
  synthetic polynucleotide sequence
gaggaaaaagagtccggacggca

SEQ ID NO: 53177 - DNA, 20 bp, Artificial sequence
  synthetic polynucleotide sequence
cctgagcacagggagcaaca

SEQ ID NO: 53178 - DNA, 21 bp, Artificial sequence
  synthetic polynucleotide sequence
tgagagggtcccattcagcaa

SEQ ID NO: 53179 - DNA, 20 bp, Artificial sequence
  synthetic polynucleotide sequence
cgtgtgcagctgaggaggga

SEQ ID NO: 53180 - DNA, 20 bp, Artificial sequence
  synthetic polynucleotide sequence
aggcccacccagaccctcca

SEQ ID NO: 53181 - DNA, 21 bp, Artificial sequence
  synthetic polynucleotide sequence
gaaaacggcctcgttgacgga

SEQ ID NO: 53182 - DNA, 20 bp, Artificial sequence
  synthetic polynucleotide sequence
cggggagagggatcgctcaa

SEQ ID NO: 53183 - DNA, 20 bp, Artificial sequence
  synthetic polynucleotide sequence
ctccccacacacacactgca

SEQ ID NO: 53184 - DNA, 20 bp, Artificial sequence
  synthetic polynucleotide sequence
ggaccgtgagtgaccagaga

SEQ ID NO: 53185 - DNA, 20 bp, Artificial sequence
  synthetic polynucleotide sequence
acaggtgtcgggctggcaga

SEQ ID NO: 53186 - DNA, 20 bp, Artificial sequence
  synthetic polynucleotide sequence
ggggatgggggtgggtgaca

SEQ ID NO: 53187 - DNA, 25 bp, Artificial sequence
  synthetic polynucleotide sequence
acatgacagggggtaaggaagagaa

SEQ ID NO: 53188 - DNA, 20 bp, Artificial sequence
  synthetic polynucleotide sequence
gacaaccggggaaagaggca

SEQ ID NO: 53189 - DNA, 21 bp, Artificial sequence
  synthetic polynucleotide sequence
tctggagaagtccacatggca

SEQ ID NO: 53190 - DNA, 20 bp, Artificial sequence
  synthetic polynucleotide sequence
cctgtggccacaaaccacca

SEQ ID NO: 53191 - DNA, 20 bp, Artificial sequence
  synthetic polynucleotide sequence
atcagcctcagccaccacca

SEQ ID NO: 53192 - DNA, 20 bp, Artificial sequence
  synthetic polynucleotide sequence
aggagggggctggagatgga

SEQ ID NO: 53193 - DNA, 22 bp, Artificial sequence
  synthetic polynucleotide sequence
atgaagccagtaagtcgtcgca

SEQ ID NO: 53194 - DNA, 23 bp, Artificial sequence
  synthetic polynucleotide sequence
gcatagatgatgcagccccagga

SEQ ID NO: 53195 - DNA, 20 bp, Artificial sequence
  synthetic polynucleotide sequence
accactgcagctgcaaccga

SEQ ID NO: 53196 - DNA, 21 bp, Artificial sequence
  synthetic polynucleotide sequence
caccaacagtgcctcaggaga

SEQ ID NO: 53197 - DNA, 20 bp, Artificial sequence
  synthetic polynucleotide sequence
gcccccagctagacgcgaga

SEQ ID NO: 53198 - DNA, 21 bp, Artificial sequence
  synthetic polynucleotide sequence
tttccaacacaggcaggtgca

SEQ ID NO: 53199 - DNA, 20 bp, Artificial sequence
  synthetic polynucleotide sequence
agagtccccatcggtcccca

SEQ ID NO: 53200 - DNA, 22 bp, Artificial sequence
  synthetic polynucleotide sequence
tcctgaccagtgggaagcaaga

SEQ ID NO: 53201 - DNA, 21 bp, Artificial sequence
  synthetic polynucleotide sequence
aggaaagagagggagtgccaa

SEQ ID NO: 53202 - DNA, 21 bp, Artificial sequence
  synthetic polynucleotide sequence
ctccaaacccctgtgagacca

SEQ ID NO: 53203 - DNA, 20 bp, Artificial sequence
  synthetic polynucleotide sequence
acccgtcccctggactggca

SEQ ID NO: 53204 - DNA, 20 bp, Artificial sequence
  synthetic polynucleotide sequence
ggagggatggagacccagaa

SEQ ID NO: 53205 - DNA, 23 bp, Artificial sequence
  synthetic polynucleotide sequence
gccaagcctccccaaatgatcca

SEQ ID NO: 53206 - DNA, 21 bp, Artificial sequence
  synthetic polynucleotide sequence
ccctgaaggctatcgccacaa

SEQ ID NO: 53207 - DNA, 23 bp, Artificial sequence
  synthetic polynucleotide sequence
gtacactgaacagaggagacaga

SEQ ID NO: 53208 - DNA, 23 bp, Artificial sequence
  synthetic polynucleotide sequence
cattccagccaatgaaaaccaga

SEQ ID NO: 53209 - DNA, 20 bp, Artificial sequence
  synthetic polynucleotide sequence
cacctggagtcccctccaca

SEQ ID NO: 53210 - DNA, 20 bp, Artificial sequence
  synthetic polynucleotide sequence
tgaggccatgcagcagagga

SEQ ID NO: 53211 - DNA, 25 bp, Artificial sequence
  synthetic polynucleotide sequence
agaccaaggaccacacagaccaaca

SEQ ID NO: 53212 - DNA, 22 bp, Artificial sequence
  synthetic polynucleotide sequence
ctgaggtccaagcaatgccaga

SEQ ID NO: 53213 - DNA, 20 bp, Artificial sequence
  synthetic polynucleotide sequence
agaagtggtctgcagcccca

SEQ ID NO: 53214 - DNA, 20 bp, Artificial sequence
  synthetic polynucleotide sequence
agacagaggggagctggaca

SEQ ID NO: 53215 - DNA, 22 bp, Artificial sequence
  synthetic polynucleotide sequence
ctgcgatggggtcaagaaggaa

SEQ ID NO: 53216 - DNA, 20 bp, Artificial sequence
  synthetic polynucleotide sequence
gcctcagaggcctgtgagga

SEQ ID NO: 53217 - DNA, 20 bp, Artificial sequence
  synthetic polynucleotide sequence
cacggttggcaccctggaga

SEQ ID NO: 53218 - DNA, 20 bp, Artificial sequence
  synthetic polynucleotide sequence
ccagggtctcaagcctgcca

SEQ ID NO: 53219 - DNA, 20 bp, Artificial sequence
  synthetic polynucleotide sequence
caccccactcctggaaccaa

SEQ ID NO: 53220 - DNA, 20 bp, Artificial sequence
  synthetic polynucleotide sequence
gcctcctcagccacgtggaa

SEQ ID NO: 53221 - DNA, 20 bp, Artificial sequence
  synthetic polynucleotide sequence
agggtccctgcccagcagca

SEQ ID NO: 53222 - DNA, 20 bp, Artificial sequence
  synthetic polynucleotide sequence
cacccagaggatagcaccga

SEQ ID NO: 53223 - DNA, 22 bp, Artificial sequence
  synthetic polynucleotide sequence
gagcctggcctaaaaactgcaa

SEQ ID NO: 53224 - DNA, 20 bp, Artificial sequence
  synthetic polynucleotide sequence
tgcaggggagcggcaacaca

SEQ ID NO: 53225 - DNA, 23 bp, Artificial sequence
  synthetic polynucleotide sequence
gtttctctaaggagcaagcagca

SEQ ID NO: 53226 - DNA, 23 bp, Artificial sequence
  synthetic polynucleotide sequence
ggattgccaggaccaaaccagga

SEQ ID NO: 53227 - DNA, 21 bp, Artificial sequence
  synthetic polynucleotide sequence
agtgggaggagagatagagga

SEQ ID NO: 53228 - DNA, 20 bp, Artificial sequence
  synthetic polynucleotide sequence
tgagacgggggaagagcaga

SEQ ID NO: 53229 - DNA, 19 bp, Artificial sequence
  synthetic polynucleotide sequence
gggcagcctgcgggagaca

SEQ ID NO: 53230 - DNA, 20 bp, Artificial sequence
  synthetic polynucleotide sequence
aaggcttggggtgggcagga

SEQ ID NO: 53231 - DNA, 22 bp, Artificial sequence
  synthetic polynucleotide sequence
cttgcagacgacaggagcagaa

SEQ ID NO: 53232 - DNA, 20 bp, Artificial sequence
  synthetic polynucleotide sequence
gggtagtgcagactccagga

SEQ ID NO: 53233 - DNA, 20 bp, Artificial sequence
  synthetic polynucleotide sequence
aggcccggctctgtgcagaa

SEQ ID NO: 53234 - DNA, 22 bp, Artificial sequence
  synthetic polynucleotide sequence
agagattgctagagaggaccca

SEQ ID NO: 53235 - DNA, 23 bp, Artificial sequence
  synthetic polynucleotide sequence
gcaactaccagcacaaaccagga

SEQ ID NO: 53236 - DNA, 21 bp, Artificial sequence
  synthetic polynucleotide sequence
tacctcctgagatgccaagca

SEQ ID NO: 53237 - DNA, 23 bp, Artificial sequence
  synthetic polynucleotide sequence
ccatgatggacacatccaagaga

SEQ ID NO: 53238 - DNA, 20 bp, Artificial sequence
  synthetic polynucleotide sequence
ctggtacccgagggacacca

SEQ ID NO: 53239 - DNA, 23 bp, Artificial sequence
  synthetic polynucleotide sequence
ggcaaggagggatccagggtaga

SEQ ID NO: 53240 - DNA, 20 bp, Artificial sequence
  synthetic polynucleotide sequence
gggcgggatcttacagggaa

SEQ ID NO: 53241 - DNA, 20 bp, Artificial sequence
  synthetic polynucleotide sequence
gacacctgaacccccagcca

SEQ ID NO: 53242 - DNA, 22 bp, Artificial sequence
  synthetic polynucleotide sequence
agtgggctggacaagagaacca

SEQ ID NO: 53243 - DNA, 20 bp, Artificial sequence
  synthetic polynucleotide sequence
accggagccacagacacaga

SEQ ID NO: 53244 - DNA, 20 bp, Artificial sequence
  synthetic polynucleotide sequence
caggcctggtgactgggaca

SEQ ID NO: 53245 - DNA, 20 bp, Artificial sequence
  synthetic polynucleotide sequence
cgccgcgaaactgtgagcaa

SEQ ID NO: 53246 - DNA, 20 bp, Artificial sequence
  synthetic polynucleotide sequence
ccccgtgctgccctgaggaa

SEQ ID NO: 53247 - DNA, 23 bp, Artificial sequence
  synthetic polynucleotide sequence
gaaggggaaaaaaagaaggggaa

SEQ ID NO: 53248 - DNA, 20 bp, Artificial sequence
  synthetic polynucleotide sequence
acgccgttgagcctggggca

SEQ ID NO: 53249 - DNA, 21 bp, Artificial sequence
  synthetic polynucleotide sequence
acaaaagggcactggttggca

SEQ ID NO: 53250 - DNA, 25 bp, Artificial sequence
  synthetic polynucleotide sequence
aagctccatgaacagaggaatgcca

SEQ ID NO: 53251 - DNA, 25 bp, Artificial sequence
  synthetic polynucleotide sequence
cctgacccacacatagcataaacca

SEQ ID NO: 53252 - DNA, 25 bp, Artificial sequence
  synthetic polynucleotide sequence
aagaggcaaggctgaaagcaagaga

SEQ ID NO: 53253 - DNA, 20 bp, Artificial sequence
  synthetic polynucleotide sequence
ccgaaccctgaacagctgga

SEQ ID NO: 53254 - DNA, 20 bp, Artificial sequence
  synthetic polynucleotide sequence
gtgtctccacgaagccagga

SEQ ID NO: 53255 - DNA, 20 bp, Artificial sequence
  synthetic polynucleotide sequence
ttcgagggagctcgagccaa

SEQ ID NO: 53256 - DNA, 20 bp, Artificial sequence
  synthetic polynucleotide sequence
ccggtgataacgaccacgca

SEQ ID NO: 53257 - DNA, 22 bp, Artificial sequence
  synthetic polynucleotide sequence
ctgctgaggagaagacagagca

SEQ ID NO: 53258 - DNA, 20 bp, Artificial sequence
  synthetic polynucleotide sequence
caggcatggacaggagggca

SEQ ID NO: 53259 - DNA, 20 bp, Artificial sequence
  synthetic polynucleotide sequence
gccttcggccacagactgaa

SEQ ID NO: 53260 - DNA, 20 bp, Artificial sequence
  synthetic polynucleotide sequence
gcaagctgaggagccaggaa

SEQ ID NO: 53261 - DNA, 20 bp, Artificial sequence
  synthetic polynucleotide sequence
gaaggtacggtgcctcccga

SEQ ID NO: 53262 - DNA, 20 bp, Artificial sequence
  synthetic polynucleotide sequence
gtagggaagcgagtgtgcca

SEQ ID NO: 53263 - DNA, 20 bp, Artificial sequence
  synthetic polynucleotide sequence
tcgaccccgacacatcagga

SEQ ID NO: 53264 - DNA, 20 bp, Artificial sequence
  synthetic polynucleotide sequence
ctggccctccctcgcaggga

SEQ ID NO: 53265 - DNA, 20 bp, Artificial sequence
  synthetic polynucleotide sequence
ggacacggctgatcatgcga

SEQ ID NO: 53266 - DNA, 20 bp, Artificial sequence
  synthetic polynucleotide sequence
ccactgacaggaggcctcaa

SEQ ID NO: 53267 - DNA, 20 bp, Artificial sequence
  synthetic polynucleotide sequence
gcatgcgtgcaggctggaca

SEQ ID NO: 53268 - DNA, 20 bp, Artificial sequence
  synthetic polynucleotide sequence
gcacacaggtcttggcccca

SEQ ID NO: 53269 - DNA, 20 bp, Artificial sequence
  synthetic polynucleotide sequence
cccccacctggtggctcaca

SEQ ID NO: 53270 - DNA, 20 bp, Artificial sequence
  synthetic polynucleotide sequence
acccaagtccacatcgccca

SEQ ID NO: 53271 - DNA, 22 bp, Artificial sequence
  synthetic polynucleotide sequence
aacagtcatctagcccaggaca

SEQ ID NO: 53272 - DNA, 22 bp, Artificial sequence
  synthetic polynucleotide sequence
agaagctcctcaaaggcacaga

SEQ ID NO: 53273 - DNA, 22 bp, Artificial sequence
  synthetic polynucleotide sequence
agaggagccgtggataatggaa

SEQ ID NO: 53274 - DNA, 23 bp, Artificial sequence
  synthetic polynucleotide sequence
gccggaaacagtcagagccacca

SEQ ID NO: 53275 - DNA, 20 bp, Artificial sequence
  synthetic polynucleotide sequence
cccccgctccaaggaatgga

SEQ ID NO: 53276 - DNA, 21 bp, Artificial sequence
  synthetic polynucleotide sequence
ctcctgaaaacaccgtcccca

SEQ ID NO: 53277 - DNA, 19 bp, Artificial sequence
  synthetic polynucleotide sequence
gcacccctgcccggtgaca

SEQ ID NO: 53278 - DNA, 20 bp, Artificial sequence
  synthetic polynucleotide sequence
gacagctgaaccctcgtgga

SEQ ID NO: 53279 - DNA, 25 bp, Artificial sequence
  synthetic polynucleotide sequence
gacgagctacccaagaatagctgaa

SEQ ID NO: 53280 - DNA, 21 bp, Artificial sequence
  synthetic polynucleotide sequence
taagccagccagctatcacca

SEQ ID NO: 53281 - DNA, 20 bp, Artificial sequence
  synthetic polynucleotide sequence
ccagccatgcctcactggga

SEQ ID NO: 53282 - DNA, 20 bp, Artificial sequence
  synthetic polynucleotide sequence
ctcatggagatgccccagca

SEQ ID NO: 53283 - DNA, 23 bp, Artificial sequence
  synthetic polynucleotide sequence
ggatcaggaaaggatgcagaaga

SEQ ID NO: 53284 - DNA, 21 bp, Artificial sequence
  synthetic polynucleotide sequence
gcccaagatgacctcctcaga

SEQ ID NO: 53285 - DNA, 22 bp, Artificial sequence
  synthetic polynucleotide sequence
atcagagagtctagagaggcca

SEQ ID NO: 53286 - DNA, 21 bp, Artificial sequence
  synthetic polynucleotide sequence
gggctggagcaaatgtcccaa

SEQ ID NO: 53287 - DNA, 21 bp, Artificial sequence
  synthetic polynucleotide sequence
gtaccctggatgcagcaggaa

SEQ ID NO: 53288 - DNA, 21 bp, Artificial sequence
  synthetic polynucleotide sequence
tggctcatcagagtccacaga

SEQ ID NO: 53289 - DNA, 18 bp, Artificial sequence
  synthetic polynucleotide sequence
cagccgtgctgccgccca

SEQ ID NO: 53290 - DNA, 20 bp, Artificial sequence
  synthetic polynucleotide sequence
ggtcacacaggtgggctgga

SEQ ID NO: 53291 - DNA, 19 bp, Artificial sequence
  synthetic polynucleotide sequence
ggggaggagaaggggcgga

SEQ ID NO: 53292 - DNA, 20 bp, Artificial sequence
  synthetic polynucleotide sequence
tcggcccctctggagaggaa

SEQ ID NO: 53293 - DNA, 19 bp, Artificial sequence
  synthetic polynucleotide sequence
ccgctgcttcggccgccca

SEQ ID NO: 53294 - DNA, 20 bp, Artificial sequence
  synthetic polynucleotide sequence
gatgccctccgtaggcgcca

SEQ ID NO: 53295 - DNA, 20 bp, Artificial sequence
  synthetic polynucleotide sequence
ggggccatgccttaggggga

SEQ ID NO: 53296 - DNA, 23 bp, Artificial sequence
  synthetic polynucleotide sequence
gttcgagaacgatctggaggaga

SEQ ID NO: 53297 - DNA, 23 bp, Artificial sequence
  synthetic polynucleotide sequence
gagaaggccattagagctcacca

SEQ ID NO: 53298 - DNA, 20 bp, Artificial sequence
  synthetic polynucleotide sequence
atatcctaccgcccccagga

SEQ ID NO: 53299 - DNA, 20 bp, Artificial sequence
  synthetic polynucleotide sequence
gcaagccccaggagtcaaga

SEQ ID NO: 53300 - DNA, 20 bp, Artificial sequence
  synthetic polynucleotide sequence
ccaatgcatgtggagcgcca

SEQ ID NO: 53301 - DNA, 25 bp, Artificial sequence
  synthetic polynucleotide sequence
aacagacatgcgagacctctaccaa

SEQ ID NO: 53302 - DNA, 21 bp, Artificial sequence
  synthetic polynucleotide sequence
tcaactctggaaacgtgccca

SEQ ID NO: 53303 - DNA, 23 bp, Artificial sequence
  synthetic polynucleotide sequence
cacagagacatgagcaccagcaa

SEQ ID NO: 53304 - DNA, 22 bp, Artificial sequence
  synthetic polynucleotide sequence
gatgccgttgaagaagggagga

SEQ ID NO: 53305 - DNA, 20 bp, Artificial sequence
  synthetic polynucleotide sequence
gctgcgtctgcacacaggaa

SEQ ID NO: 53306 - DNA, 21 bp, Artificial sequence
  synthetic polynucleotide sequence
actgctcaagggagatccaga

SEQ ID NO: 53307 - DNA, 20 bp, Artificial sequence
  synthetic polynucleotide sequence
gccacaggcatgtgtggcca

SEQ ID NO: 53308 - DNA, 25 bp, Artificial sequence
  synthetic polynucleotide sequence
gacacaatctccaacatgcacagga

SEQ ID NO: 53309 - DNA, 20 bp, Artificial sequence
  synthetic polynucleotide sequence
gcgaggcatagcattcccca

SEQ ID NO: 53310 - DNA, 20 bp, Artificial sequence
  synthetic polynucleotide sequence
cagcgggagggctgcatgga

SEQ ID NO: 53311 - DNA, 20 bp, Artificial sequence
  synthetic polynucleotide sequence
gcctcaaccagagctgtgga

SEQ ID NO: 53312 - DNA, 20 bp, Artificial sequence
  synthetic polynucleotide sequence
gacacacagcaggctgggca

SEQ ID NO: 53313 - DNA, 20 bp, Artificial sequence
  synthetic polynucleotide sequence
cgaacagcagtgtgctccca

SEQ ID NO: 53314 - DNA, 20 bp, Artificial sequence
  synthetic polynucleotide sequence
cagccatgagccgtggccca

SEQ ID NO: 53315 - DNA, 20 bp, Artificial sequence
  synthetic polynucleotide sequence
cagcgcgggtactgctggga

SEQ ID NO: 53316 - DNA, 20 bp, Artificial sequence
  synthetic polynucleotide sequence
gatggtgaagggtggaccca

SEQ ID NO: 53317 - DNA, 20 bp, Artificial sequence
  synthetic polynucleotide sequence
ccagctggatgaccggggca

SEQ ID NO: 53318 - DNA, 20 bp, Artificial sequence
  synthetic polynucleotide sequence
acgaggctgggtagtgccca

SEQ ID NO: 53319 - DNA, 19 bp, Artificial sequence
  synthetic polynucleotide sequence
cgtgggccctgcgtcggga

SEQ ID NO: 53320 - DNA, 20 bp, Artificial sequence
  synthetic polynucleotide sequence
atacccacccctaggctgca

SEQ ID NO: 53321 - DNA, 19 bp, Artificial sequence
  synthetic polynucleotide sequence
cggggatgggggggaagca

SEQ ID NO: 53322 - DNA, 20 bp, Artificial sequence
  synthetic polynucleotide sequence
tccgcctcgggcagtcaaca

SEQ ID NO: 53323 - DNA, 20 bp, Artificial sequence
  synthetic polynucleotide sequence
tgcgggatgctggggcccaa

SEQ ID NO: 53324 - DNA, 21 bp, Artificial sequence
  synthetic polynucleotide sequence
gtccacaaaggtgtcccagca

SEQ ID NO: 53325 - DNA, 23 bp, Artificial sequence
  synthetic polynucleotide sequence
catagatactggagaaggagcga

SEQ ID NO: 53326 - DNA, 25 bp, Artificial sequence
  synthetic polynucleotide sequence
agcagagccaggactcaaattcaca

SEQ ID NO: 53327 - DNA, 22 bp, Artificial sequence
  synthetic polynucleotide sequence
ccatgagggcggagtgaatgga

SEQ ID NO: 53328 - DNA, 25 bp, Artificial sequence
  synthetic polynucleotide sequence
atggtggaaggaatcacatgggcaa

SEQ ID NO: 53329 - DNA, 21 bp, Artificial sequence
  synthetic polynucleotide sequence
atgacagagaagccagaggca

SEQ ID NO: 53330 - DNA, 22 bp, Artificial sequence
  synthetic polynucleotide sequence
gggcaggggagaaagaaaggga

SEQ ID NO: 53331 - DNA, 20 bp, Artificial sequence
  synthetic polynucleotide sequence
caggacagcggcaagtacga

SEQ ID NO: 53332 - DNA, 19 bp, Artificial sequence
  synthetic polynucleotide sequence
gccacgtcgacgcgagcga

SEQ ID NO: 53333 - DNA, 20 bp, Artificial sequence
  synthetic polynucleotide sequence
acccaacaccagctgtgcca

SEQ ID NO: 53334 - DNA, 20 bp, Artificial sequence
  synthetic polynucleotide sequence
ctgggtctcagggagccgga

SEQ ID NO: 53335 - DNA, 23 bp, Artificial sequence
  synthetic polynucleotide sequence
ccttagagaccaactagctgcca

SEQ ID NO: 53336 - DNA, 21 bp, Artificial sequence
  synthetic polynucleotide sequence
gggggcaaatgcagcagaaga

SEQ ID NO: 53337 - DNA, 20 bp, Artificial sequence
  synthetic polynucleotide sequence
cgaacagccgtgtgctccca

SEQ ID NO: 53338 - DNA, 20 bp, Artificial sequence
  synthetic polynucleotide sequence
gccatgagccctggcccaga

SEQ ID NO: 53339 - DNA, 20 bp, Artificial sequence
  synthetic polynucleotide sequence
gacccagccagcccactgga

SEQ ID NO: 53340 - DNA, 20 bp, Artificial sequence
  synthetic polynucleotide sequence
gttaggccctgggaggccga

SEQ ID NO: 53341 - DNA, 22 bp, Artificial sequence
  synthetic polynucleotide sequence
atcttagcaacatccaaggcca

SEQ ID NO: 53342 - DNA, 25 bp, Artificial sequence
  synthetic polynucleotide sequence
aatggcaacagaaattgggccagga

SEQ ID NO: 53343 - DNA, 20 bp, Artificial sequence
  synthetic polynucleotide sequence
cagccagagtgtgccctgga

SEQ ID NO: 53344 - DNA, 20 bp, Artificial sequence
  synthetic polynucleotide sequence
agcctggagtggggacagga

SEQ ID NO: 53345 - DNA, 20 bp, Artificial sequence
  synthetic polynucleotide sequence
tccagctccacgcccaccca

SEQ ID NO: 53346 - DNA, 20 bp, Artificial sequence
  synthetic polynucleotide sequence
tctctccccagacgggcaca

SEQ ID NO: 53347 - DNA, 18 bp, Artificial sequence
  synthetic polynucleotide sequence
gtggcctgggcctgggca

SEQ ID NO: 53348 - DNA, 20 bp, Artificial sequence
  synthetic polynucleotide sequence
ctgacacgacacctgcgaca

SEQ ID NO: 53349 - DNA, 20 bp, Artificial sequence
  synthetic polynucleotide sequence
ctggatggaaggcacaggga

SEQ ID NO: 53350 - DNA, 21 bp, Artificial sequence
  synthetic polynucleotide sequence
tggagacatgactgagaggga

SEQ ID NO: 53351 - DNA, 23 bp, Artificial sequence
  synthetic polynucleotide sequence
gaagtgaaggcaaatgtgggaga

SEQ ID NO: 53352 - DNA, 22 bp, Artificial sequence
  synthetic polynucleotide sequence
aagagcaggaagcagtggagaa

SEQ ID NO: 53353 - DNA, 20 bp, Artificial sequence
  synthetic polynucleotide sequence
cagcacaaccagtcctccca

SEQ ID NO: 53354 - DNA, 21 bp, Artificial sequence
  synthetic polynucleotide sequence
tgtccaaagagaagcccagga

SEQ ID NO: 53355 - DNA, 19 bp, Artificial sequence
  synthetic polynucleotide sequence
gctgggccgggcctgtaga

SEQ ID NO: 53356 - DNA, 20 bp, Artificial sequence
  synthetic polynucleotide sequence
gaggcagaagtcagcccgaa

SEQ ID NO: 53357 - DNA, 23 bp, Artificial sequence
  synthetic polynucleotide sequence
ggcaggcacagaagtgacatcga

SEQ ID NO: 53358 - DNA, 21 bp, Artificial sequence
  synthetic polynucleotide sequence
ggcttcagcacgtaagccaca

SEQ ID NO: 53359 - DNA, 20 bp, Artificial sequence
  synthetic polynucleotide sequence
tcaggacactcgctcaggga

SEQ ID NO: 53360 - DNA, 22 bp, Artificial sequence
  synthetic polynucleotide sequence
aaagaccgtaactccaacagca

SEQ ID NO: 53361 - DNA, 20 bp, Artificial sequence
  synthetic polynucleotide sequence
ctggatggaaggcacaggga

SEQ ID NO: 53362 - DNA, 20 bp, Artificial sequence
  synthetic polynucleotide sequence
ctgagagggaggccaacaga

SEQ ID NO: 53363 - DNA, 20 bp, Artificial sequence
  synthetic polynucleotide sequence
gcagagggaccctgctccaa

SEQ ID NO: 53364 - DNA, 22 bp, Artificial sequence
  synthetic polynucleotide sequence
tatgacagtcacccctaaagca

SEQ ID NO: 53365 - DNA, 21 bp, Artificial sequence
  synthetic polynucleotide sequence
acagaggctcatcaggaagga

SEQ ID NO: 53366 - DNA, 21 bp, Artificial sequence
  synthetic polynucleotide sequence
gagcgtatgggacatggggaa

SEQ ID NO: 53367 - DNA, 20 bp, Artificial sequence
  synthetic polynucleotide sequence
gcctctccactcccaacaga

SEQ ID NO: 53368 - DNA, 20 bp, Artificial sequence
  synthetic polynucleotide sequence
tgggaggaactgctggagga

SEQ ID NO: 53369 - DNA, 19 bp, Artificial sequence
  synthetic polynucleotide sequence
ctgggtcctggggccccaa

SEQ ID NO: 53370 - DNA, 23 bp, Artificial sequence
  synthetic polynucleotide sequence
gtgtaggagtaggcaaaccacga

SEQ ID NO: 53371 - DNA, 20 bp, Artificial sequence
  synthetic polynucleotide sequence
cccacaactcccagagggca

SEQ ID NO: 53372 - DNA, 20 bp, Artificial sequence
  synthetic polynucleotide sequence
ctggaggagagacggcggca

SEQ ID NO: 53373 - DNA, 22 bp, Artificial sequence
  synthetic polynucleotide sequence
tggaggagttggaagagatcca

SEQ ID NO: 53374 - DNA, 20 bp, Artificial sequence
  synthetic polynucleotide sequence
tctaggaaaggtgggcgcga

SEQ ID NO: 53375 - DNA, 20 bp, Artificial sequence
  synthetic polynucleotide sequence
tcctgagccacccgtggcca

SEQ ID NO: 53376 - DNA, 20 bp, Artificial sequence
  synthetic polynucleotide sequence
agggaaggtagatggggcca

SEQ ID NO: 53377 - DNA, 21 bp, Artificial sequence
  synthetic polynucleotide sequence
atgaggaacaggggcaaggaa

SEQ ID NO: 53378 - DNA, 20 bp, Artificial sequence
  synthetic polynucleotide sequence
ggctgcagtcaaggtgccaa

SEQ ID NO: 53379 - DNA, 20 bp, Artificial sequence
  synthetic polynucleotide sequence
tgacctaggcccctacccca

SEQ ID NO: 53380 - DNA, 20 bp, Artificial sequence
  synthetic polynucleotide sequence
ccagagagggcagggatgga

SEQ ID NO: 53381 - DNA, 21 bp, Artificial sequence
  synthetic polynucleotide sequence
gccaggaacaggttcacccaa

SEQ ID NO: 53382 - DNA, 20 bp, Artificial sequence
  synthetic polynucleotide sequence
gcaggcccatctcctggcca

SEQ ID NO: 53383 - DNA, 20 bp, Artificial sequence
  synthetic polynucleotide sequence
ggccgccgtcgcaagaagca

SEQ ID NO: 53384 - DNA, 20 bp, Artificial sequence
  synthetic polynucleotide sequence
ctccaccaccgccaccgcca

SEQ ID NO: 53385 - DNA, 25 bp, Artificial sequence
  synthetic polynucleotide sequence
atggaaggaatagagggagagcaga

SEQ ID NO: 53386 - DNA, 21 bp, Artificial sequence
  synthetic polynucleotide sequence
ctggaaaactggagggtggga

SEQ ID NO: 53387 - DNA, 20 bp, Artificial sequence
  synthetic polynucleotide sequence
gggcagccatagtgtgccga

SEQ ID NO: 53388 - DNA, 19 bp, Artificial sequence
  synthetic polynucleotide sequence
gctggtggggctgcggcaa

SEQ ID NO: 53389 - DNA, 23 bp, Artificial sequence
  synthetic polynucleotide sequence
ctgcagagtcaactgcctcagaa

SEQ ID NO: 53390 - DNA, 20 bp, Artificial sequence
  synthetic polynucleotide sequence
gcagaaggggtgagtcggca

SEQ ID NO: 53391 - DNA, 20 bp, Artificial sequence
  synthetic polynucleotide sequence
tgtccaaagatggccgccga

SEQ ID NO: 53392 - DNA, 20 bp, Artificial sequence
  synthetic polynucleotide sequence
ggccgggatgcccacaagga

SEQ ID NO: 53393 - DNA, 25 bp, Artificial sequence
  synthetic polynucleotide sequence
gaaacaggatttaagaggggaggga

SEQ ID NO: 53394 - DNA, 23 bp, Artificial sequence
  synthetic polynucleotide sequence
cctagcacataaggagtggtcaa

SEQ ID NO: 53395 - DNA, 20 bp, Artificial sequence
  synthetic polynucleotide sequence
tcttgccaggaaccccagga

SEQ ID NO: 53396 - DNA, 25 bp, Artificial sequence
  synthetic polynucleotide sequence
gaaactgcaaattgccaccacagga

SEQ ID NO: 53397 - DNA, 20 bp, Artificial sequence
  synthetic polynucleotide sequence
cacagcctccagcttccaga

SEQ ID NO: 53398 - DNA, 21 bp, Artificial sequence
  synthetic polynucleotide sequence
agccaggtgagttaacgagca

SEQ ID NO: 53399 - DNA, 20 bp, Artificial sequence
  synthetic polynucleotide sequence
accacggctcccggcatgca

SEQ ID NO: 53400 - DNA, 20 bp, Artificial sequence
  synthetic polynucleotide sequence
ccaaagagggctgcagacca

SEQ ID NO: 53401 - DNA, 22 bp, Artificial sequence
  synthetic polynucleotide sequence
gagaagactccgctgtacagga

SEQ ID NO: 53402 - DNA, 23 bp, Artificial sequence
  synthetic polynucleotide sequence
gaagatgtagggaagagctggga

SEQ ID NO: 53403 - DNA, 22 bp, Artificial sequence
  synthetic polynucleotide sequence
atgacaaccgcatgatgctcaa

SEQ ID NO: 53404 - DNA, 20 bp, Artificial sequence
  synthetic polynucleotide sequence
ggaagcccagcagctgtgca

SEQ ID NO: 53405 - DNA, 23 bp, Artificial sequence
  synthetic polynucleotide sequence
ctggataacatcaccgatgagga

SEQ ID NO: 53406 - DNA, 21 bp, Artificial sequence
  synthetic polynucleotide sequence
ctcactgcagacaccatgcca

SEQ ID NO: 53407 - DNA, 18 bp, Artificial sequence
  synthetic polynucleotide sequence
gggcctgcccagcctgga

SEQ ID NO: 53408 - DNA, 20 bp, Artificial sequence
  synthetic polynucleotide sequence
gacctgggccatgggcagaa

SEQ ID NO: 53409 - DNA, 22 bp, Artificial sequence
  synthetic polynucleotide sequence
tcacccccaaaagaacctccca

SEQ ID NO: 53410 - DNA, 21 bp, Artificial sequence
  synthetic polynucleotide sequence
tgtccagaacagggaaaccca

SEQ ID NO: 53411 - DNA, 20 bp, Artificial sequence
  synthetic polynucleotide sequence
caggcgtgaacggtgaccga

SEQ ID NO: 53412 - DNA, 20 bp, Artificial sequence
  synthetic polynucleotide sequence
ttcaggcccggtgaccggga

SEQ ID NO: 53413 - DNA, 19 bp, Artificial sequence
  synthetic polynucleotide sequence
gcgcggctggaagcgcgca

SEQ ID NO: 53414 - DNA, 20 bp, Artificial sequence
  synthetic polynucleotide sequence
gggcatttccaccgagcgca

SEQ ID NO: 53415 - DNA, 22 bp, Artificial sequence
  synthetic polynucleotide sequence
ccacacaggggaggtgatagca

SEQ ID NO: 53416 - DNA, 20 bp, Artificial sequence
  synthetic polynucleotide sequence
acccactcccagggagacca

SEQ ID NO: 53417 - DNA, 22 bp, Artificial sequence
  synthetic polynucleotide sequence
tcaagatcatcgcacccccaga

SEQ ID NO: 53418 - DNA, 20 bp, Artificial sequence
  synthetic polynucleotide sequence
ggtggacagtgaggccagga

SEQ ID NO: 53419 - DNA, 17 bp, Artificial sequence
  synthetic polynucleotide sequence
gtgaaccggcgagcaca

SEQ ID NO: 53420 - DNA, 18 bp, Artificial sequence
  synthetic polynucleotide sequence
ccacctgccccagcacca

SEQ ID NO: 53421 - DNA, 18 bp, Artificial sequence
  synthetic polynucleotide sequence
ttggtgaacaggcgacca

SEQ ID NO: 53422 - DNA, 20 bp, Artificial sequence
  synthetic polynucleotide sequence
tcacgagctcaacaagtgca

SEQ ID NO: 53423 - DNA, 21 bp, Artificial sequence
  synthetic polynucleotide sequence
ggaggcgtccatcaacctcaa

SEQ ID NO: 53424 - DNA, 18 bp, Artificial sequence
  synthetic polynucleotide sequence
ccccaggccttcagggca

SEQ ID NO: 53425 - DNA, 20 bp, Artificial sequence
  synthetic polynucleotide sequence
gaggactgaccactcgacca

SEQ ID NO: 53426 - DNA, 18 bp, Artificial sequence
  synthetic polynucleotide sequence
tgacaacaccgcccacca

SEQ ID NO: 53427 - DNA, 20 bp, Artificial sequence
  synthetic polynucleotide sequence
caaaccagggctatgaagca

SEQ ID NO: 53428 - DNA, 19 bp, Artificial sequence
  synthetic polynucleotide sequence
ctcagttagacgcacgcca

SEQ ID NO: 53429 - DNA, 22 bp, Artificial sequence
  synthetic polynucleotide sequence
acgtcatccagcagagaatgga

SEQ ID NO: 53430 - DNA, 18 bp, Artificial sequence
  synthetic polynucleotide sequence
tggttcacacggcaggca

SEQ ID NO: 53431 - DNA, 21 bp, Artificial sequence
  synthetic polynucleotide sequence
gccatggaactcagcgccgaa

SEQ ID NO: 53432 - DNA, 19 bp, Artificial sequence
  synthetic polynucleotide sequence
tcccctcgaacttggccga

SEQ ID NO: 53433 - DNA, 18 bp, Artificial sequence
  synthetic polynucleotide sequence
tgggcagaatcccacaga

SEQ ID NO: 53434 - DNA, 19 bp, Artificial sequence
  synthetic polynucleotide sequence
atggcgaagttctgcagca

SEQ ID NO: 53435 - DNA, 20 bp, Artificial sequence
  synthetic polynucleotide sequence
ggcacttggatccacccaga

SEQ ID NO: 53436 - DNA, 20 bp, Artificial sequence
  synthetic polynucleotide sequence
gtgccagacttgacctgcca

SEQ ID NO: 53437 - DNA, 20 bp, Artificial sequence
  synthetic polynucleotide sequence
gacgcagagaaacctgagga

SEQ ID NO: 53438 - DNA, 18 bp, Artificial sequence
  synthetic polynucleotide sequence
aatcacaggtcgctgcca

SEQ ID NO: 53439 - DNA, 22 bp, Artificial sequence
  synthetic polynucleotide sequence
gagaccaaaccagaaacctcca

SEQ ID NO: 53440 - DNA, 21 bp, Artificial sequence
  synthetic polynucleotide sequence
tgaaagcagctgctgtgagca

SEQ ID NO: 53441 - DNA, 20 bp, Artificial sequence
  synthetic polynucleotide sequence
tgggggcttcagtggaggaa

SEQ ID NO: 53442 - DNA, 21 bp, Artificial sequence
  synthetic polynucleotide sequence
tggttctgggcacactccaga

SEQ ID NO: 53443 - DNA, 20 bp, Artificial sequence
  synthetic polynucleotide sequence
ctcggatccacagcagccca

SEQ ID NO: 53444 - DNA, 21 bp, Artificial sequence
  synthetic polynucleotide sequence
ctccccatcatcactgcagga

SEQ ID NO: 53445 - DNA, 21 bp, Artificial sequence
  synthetic polynucleotide sequence
ccccctcccagaagaagtgga

SEQ ID NO: 53446 - DNA, 20 bp, Artificial sequence
  synthetic polynucleotide sequence
gtaccgatgcactccccgga

SEQ ID NO: 53447 - DNA, 18 bp, Artificial sequence
  synthetic polynucleotide sequence
ctggcaaagaaggcggca

SEQ ID NO: 53448 - DNA, 18 bp, Artificial sequence
  synthetic polynucleotide sequence
ccagcaggaccatcagca

SEQ ID NO: 53449 - DNA, 19 bp, Artificial sequence
  synthetic polynucleotide sequence
gaggtcctagtggcccaca

SEQ ID NO: 53450 - DNA, 20 bp, Artificial sequence
  synthetic polynucleotide sequence
gtgaccagcgataccaggca

SEQ ID NO: 53451 - DNA, 25 bp, Artificial sequence
  synthetic polynucleotide sequence
aggctgtaaaacggaaaggttcgga

SEQ ID NO: 53452 - DNA, 25 bp, Artificial sequence
  synthetic polynucleotide sequence
caaggacgtcacaggtaacaggcaa

SEQ ID NO: 53453 - DNA, 21 bp, Artificial sequence
  synthetic polynucleotide sequence
ccgtaggagccactatgagga

SEQ ID NO: 53454 - DNA, 22 bp, Artificial sequence
  synthetic polynucleotide sequence
ggaagggtgtagcaaatgcaga

SEQ ID NO: 53455 - DNA, 20 bp, Artificial sequence
  synthetic polynucleotide sequence
cagggtccctggccagtgga

SEQ ID NO: 53456 - DNA, 20 bp, Artificial sequence
  synthetic polynucleotide sequence
taaaaccgccctcccccaca

SEQ ID NO: 53457 - DNA, 20 bp, Artificial sequence
  synthetic polynucleotide sequence
cagctctgaggactgcacca

SEQ ID NO: 53458 - DNA, 20 bp, Artificial sequence
  synthetic polynucleotide sequence
agtggggctccaggcagcca

SEQ ID NO: 53459 - DNA, 20 bp, Artificial sequence
  synthetic polynucleotide sequence
cggaccccttacaccctgca

SEQ ID NO: 53460 - DNA, 21 bp, Artificial sequence
  synthetic polynucleotide sequence
caaggatgagtggactccgca

SEQ ID NO: 53461 - DNA, 18 bp, Artificial sequence
  synthetic polynucleotide sequence
tctggccaacacgcctca

SEQ ID NO: 53462 - DNA, 20 bp, Artificial sequence
  synthetic polynucleotide sequence
gtccaggtgggcagaagtca

SEQ ID NO: 53463 - DNA, 20 bp, Artificial sequence
  synthetic polynucleotide sequence
ctggacaagagccatgacca

SEQ ID NO: 53464 - DNA, 22 bp, Artificial sequence
  synthetic polynucleotide sequence
tgtaggaagaggctgtagtgga

SEQ ID NO: 53465 - DNA, 20 bp, Artificial sequence
  synthetic polynucleotide sequence
caacgattacctggcggaca

SEQ ID NO: 53466 - DNA, 22 bp, Artificial sequence
  synthetic polynucleotide sequence
taccaacgtagggcatgacaca

SEQ ID NO: 53467 - DNA, 21 bp, Artificial sequence
  synthetic polynucleotide sequence
tgctgagcccaaggccaagga

SEQ ID NO: 53468 - DNA, 23 bp, Artificial sequence
  synthetic polynucleotide sequence
gaaatatggcagtgccacagaga

SEQ ID NO: 53469 - DNA, 18 bp, Artificial sequence
  synthetic polynucleotide sequence
ccccaacatcctcaccga

SEQ ID NO: 53470 - DNA, 18 bp, Artificial sequence
  synthetic polynucleotide sequence
cgtggacgtcgaagcgca

SEQ ID NO: 53471 - DNA, 21 bp, Artificial sequence
  synthetic polynucleotide sequence
tcagtccaaagcctcaaagga

SEQ ID NO: 53472 - DNA, 18 bp, Artificial sequence
  synthetic polynucleotide sequence
cccctcctcgcaactcca

SEQ ID NO: 53473 - DNA, 18 bp, Artificial sequence
  synthetic polynucleotide sequence
tacgaggcgcaaggtgga

SEQ ID NO: 53474 - DNA, 19 bp, Artificial sequence
  synthetic polynucleotide sequence
cgacttgaccctgaccgga

SEQ ID NO: 53475 - DNA, 20 bp, Artificial sequence
  synthetic polynucleotide sequence
gaggaggagaggggagggga

SEQ ID NO: 53476 - DNA, 20 bp, Artificial sequence
  synthetic polynucleotide sequence
gcagggaagggtaaagccca

SEQ ID NO: 53477 - DNA, 20 bp, Artificial sequence
  synthetic polynucleotide sequence
ccaggaaacggtcgcccaga

SEQ ID NO: 53478 - DNA, 18 bp, Artificial sequence
  synthetic polynucleotide sequence
accccgcactggcccaga

SEQ ID NO: 53479 - DNA, 19 bp, Artificial sequence
  synthetic polynucleotide sequence
ggtccttgcacccccggaa

SEQ ID NO: 53480 - DNA, 22 bp, Artificial sequence
  synthetic polynucleotide sequence
caatgccacaggtagttggaca

SEQ ID NO: 53481 - DNA, 22 bp, Artificial sequence
  synthetic polynucleotide sequence
gaggaaatagccctgtccagga

SEQ ID NO: 53482 - DNA, 21 bp, Artificial sequence
  synthetic polynucleotide sequence
cggccagtgacagcatacaca

SEQ ID NO: 53483 - DNA, 22 bp, Artificial sequence
  synthetic polynucleotide sequence
aactgcacaaactggccactga

SEQ ID NO: 53484 - DNA, 21 bp, Artificial sequence
  synthetic polynucleotide sequence
agttggtcacgtggtcaccca

SEQ ID NO: 53485 - DNA, 20 bp, Artificial sequence
  synthetic polynucleotide sequence
ctgggctacactgagcacca

SEQ ID NO: 53486 - DNA, 20 bp, Artificial sequence
  synthetic polynucleotide sequence
ccaccctgttgctgtagcca

SEQ ID NO: 53487 - DNA, 18 bp, Artificial sequence
  synthetic polynucleotide sequence
ccaagaagccaggccaca

SEQ ID NO: 53488 - DNA, 20 bp, Artificial sequence
  synthetic polynucleotide sequence
ccatgcacggcagatcccca

SEQ ID NO: 53489 - DNA, 19 bp, Artificial sequence
  synthetic polynucleotide sequence
ctgactatgtgccgagcga

SEQ ID NO: 53490 - DNA, 17 bp, Artificial sequence
  synthetic polynucleotide sequence
ctggccacccacgtcaa

SEQ ID NO: 53491 - DNA, 18 bp, Artificial sequence
  synthetic polynucleotide sequence
ctatgaggcgggcaagga

SEQ ID NO: 53492 - DNA, 18 bp, Artificial sequence
  synthetic polynucleotide sequence
aacgcatccaggcagcca

SEQ ID NO: 53493 - DNA, 21 bp, Artificial sequence
  synthetic polynucleotide sequence
gcaagacagtgggctggtgaa

SEQ ID NO: 53494 - DNA, 20 bp, Artificial sequence
  synthetic polynucleotide sequence
cccagtcccattcgccacga

SEQ ID NO: 53495 - DNA, 22 bp, Artificial sequence
  synthetic polynucleotide sequence
tcggtaagggtaaaggagcaga

SEQ ID NO: 53496 - DNA, 22 bp, Artificial sequence
  synthetic polynucleotide sequence
tcaagggcataggatacctgca

SEQ ID NO: 53497 - DNA, 20 bp, Artificial sequence
  synthetic polynucleotide sequence
gctggcccctggaataagca

SEQ ID NO: 53498 - DNA, 23 bp, Artificial sequence
  synthetic polynucleotide sequence
gaagtaaccaaggtcaggcagaa

SEQ ID NO: 53499 - DNA, 20 bp, Artificial sequence
  synthetic polynucleotide sequence
atcctggagctggccggcaa

SEQ ID NO: 53500 - DNA, 20 bp, Artificial sequence
  synthetic polynucleotide sequence
cagctgcaagtggcgcggga

SEQ ID NO: 53501 - DNA, 20 bp, Artificial sequence
  synthetic polynucleotide sequence
atcatcccccgacacctgca

SEQ ID NO: 53502 - DNA, 20 bp, Artificial sequence
  synthetic polynucleotide sequence
cagaacaccgccctgagcaa

SEQ ID NO: 53503 - DNA, 22 bp, Artificial sequence
  synthetic polynucleotide sequence
ctaagaagacggagagccacca

SEQ ID NO: 53504 - DNA, 20 bp, Artificial sequence
  synthetic polynucleotide sequence
gactcgggatcactgacgga

SEQ ID NO: 53505 - DNA, 20 bp, Artificial sequence
  synthetic polynucleotide sequence
ttcgagcgcatcgcaggcga

SEQ ID NO: 53506 - DNA, 20 bp, Artificial sequence
  synthetic polynucleotide sequence
cagctcccccggaagcagca

SEQ ID NO: 53507 - DNA, 20 bp, Artificial sequence
  synthetic polynucleotide sequence
ccaggggagctggccaagca

SEQ ID NO: 53508 - DNA, 20 bp, Artificial sequence
  synthetic polynucleotide sequence
gtgggccgagactgaccgaa

SEQ ID NO: 53509 - DNA, 22 bp, Artificial sequence
  synthetic polynucleotide sequence
gtcactatcatgcccaaggaca

SEQ ID NO: 53510 - DNA, 20 bp, Artificial sequence
  synthetic polynucleotide sequence
ggaccgtcagagagaccaca

SEQ ID NO: 53511 - DNA, 25 bp, Artificial sequence
  synthetic polynucleotide sequence
cgagaaatcgcccaagacttcaaga

SEQ ID NO: 53512 - DNA, 23 bp, Artificial sequence
  synthetic polynucleotide sequence
gccctaccaagtaggcctcacaa

SEQ ID NO: 53513 - DNA, 20 bp, Artificial sequence
  synthetic polynucleotide sequence
gtgcgagaaatcgcccagga

SEQ ID NO: 53514 - DNA, 20 bp, Artificial sequence
  synthetic polynucleotide sequence
ccaccaggtaggcctcacaa

SEQ ID NO: 53515 - DNA, 20 bp, Artificial sequence
  synthetic polynucleotide sequence
aggcatcaccaaaccggcca

SEQ ID NO: 53516 - DNA, 23 bp, Artificial sequence
  synthetic polynucleotide sequence
gcgcgtaaaccacatccatggca

SEQ ID NO: 53517 - DNA, 20 bp, Artificial sequence
  synthetic polynucleotide sequence
caccgtaaggtcctgcgaga

SEQ ID NO: 53518 - DNA, 20 bp, Artificial sequence
  synthetic polynucleotide sequence
tgcgcttgacacccccgcga

SEQ ID NO: 53519 - DNA, 19 bp, Artificial sequence
  synthetic polynucleotide sequence
cgcgataacatccagggca

SEQ ID NO: 53520 - DNA, 21 bp, Artificial sequence
  synthetic polynucleotide sequence
gtgtaagtgacagcgtcacga

SEQ ID NO: 53521 - DNA, 20 bp, Artificial sequence
  synthetic polynucleotide sequence
agagcacgccaagcgcaaga

SEQ ID NO: 53522 - DNA, 23 bp, Artificial sequence
  synthetic polynucleotide sequence
cgctcaaccaccgaaaccgtaga

SEQ ID NO: 53523 - DNA, 19 bp, Artificial sequence
  synthetic polynucleotide sequence
gcaaggccccgaggaagca

SEQ ID NO: 53524 - DNA, 18 bp, Artificial sequence
  synthetic polynucleotide sequence
tacggtgccgggccggta

SEQ ID NO: 53525 - DNA, 20 bp, Artificial sequence
  synthetic polynucleotide sequence
gcagtcacctacaccgagca

SEQ ID NO: 53526 - DNA, 20 bp, Artificial sequence
  synthetic polynucleotide sequence
gcgcttgagcgcgtacacca

SEQ ID NO: 53527 - DNA, 21 bp, Artificial sequence
  synthetic polynucleotide sequence
cctaaggacatccagctggca

SEQ ID NO: 53528 - DNA, 20 bp, Artificial sequence
  synthetic polynucleotide sequence
caacctctcaggtggcgaga

SEQ ID NO: 53529 - DNA, 20 bp, Artificial sequence
  synthetic polynucleotide sequence
ccccacccccatgtccacca

SEQ ID NO: 53530 - DNA, 25 bp, Artificial sequence
  synthetic polynucleotide sequence
aacaggaaagatgattggggaggga

SEQ ID NO: 53531 - DNA, 18 bp, Artificial sequence
  synthetic polynucleotide sequence
aggctgcgtgcagcgaca

SEQ ID NO: 53532 - DNA, 21 bp, Artificial sequence
  synthetic polynucleotide sequence
gctaacagggacgcagacaca

SEQ ID NO: 53533 - DNA, 22 bp, Artificial sequence
  synthetic polynucleotide sequence
tctggagtctagacggctcaga

SEQ ID NO: 53534 - DNA, 21 bp, Artificial sequence
  synthetic polynucleotide sequence
tacgagcagtgatgcctacca

SEQ ID NO: 53535 - DNA, 22 bp, Artificial sequence
  synthetic polynucleotide sequence
aaagccctgtcaaagcaagaga

SEQ ID NO: 53536 - DNA, 18 bp, Artificial sequence
  synthetic polynucleotide sequence
tagccatccccactgcca

SEQ ID NO: 53537 - DNA, 21 bp, Artificial sequence
  synthetic polynucleotide sequence
tgatgagagcctgaggagcca

SEQ ID NO: 53538 - DNA, 21 bp, Artificial sequence
  synthetic polynucleotide sequence
gctgcatccacctcctccaca

SEQ ID NO: 53539 - DNA, 20 bp, Artificial sequence
  synthetic polynucleotide sequence
ggatgacagagacagcgcca

SEQ ID NO: 53540 - DNA, 22 bp, Artificial sequence
  synthetic polynucleotide sequence
aggatggggagaacagtgagca

SEQ ID NO: 53541 - DNA, 20 bp, Artificial sequence
  synthetic polynucleotide sequence
gcacggaaggtggagaggga

SEQ ID NO: 53542 - DNA, 22 bp, Artificial sequence
  synthetic polynucleotide sequence
gaaacgaataccttgagcccca

SEQ ID NO: 53543 - DNA, 21 bp, Artificial sequence
  synthetic polynucleotide sequence
atgaccagtcaacaggggaca

SEQ ID NO: 53544 - DNA, 20 bp, Artificial sequence
  synthetic polynucleotide sequence
tatactgcctgaccaaggaa

SEQ ID NO: 53545 - DNA, 20 bp, Artificial sequence
  synthetic polynucleotide sequence
ccagacccactccaaccgca

SEQ ID NO: 53546 - DNA, 21 bp, Artificial sequence
  synthetic polynucleotide sequence
agaggggggatctcatcagga

SEQ ID NO: 53547 - DNA, 20 bp, Artificial sequence
  synthetic polynucleotide sequence
tagccgcccatagcctgcaa

SEQ ID NO: 53548 - DNA, 20 bp, Artificial sequence
  synthetic polynucleotide sequence
ccaagggggcaggggcaaca

SEQ ID NO: 53549 - DNA, 20 bp, Artificial sequence
  synthetic polynucleotide sequence
aggcatcactgaggccagga

SEQ ID NO: 53550 - DNA, 20 bp, Artificial sequence
  synthetic polynucleotide sequence
gggcagggcgaggaatggaa

SEQ ID NO: 53551 - DNA, 21 bp, Artificial sequence
  synthetic polynucleotide sequence
aaaatacagcccgaactgcaa

SEQ ID NO: 53552 - DNA, 19 bp, Artificial sequence
  synthetic polynucleotide sequence
caaggacccacccatgaca

SEQ ID NO: 53553 - DNA, 20 bp, Artificial sequence
  synthetic polynucleotide sequence
gctgggaacccgactgtgaa

SEQ ID NO: 53554 - DNA, 25 bp, Artificial sequence
  synthetic polynucleotide sequence
tgctgaaggacaacacacatgcaga

SEQ ID NO: 53555 - DNA, 18 bp, Artificial sequence
  synthetic polynucleotide sequence
ggcaaaaccccaggagca

SEQ ID NO: 53556 - DNA, 21 bp, Artificial sequence
  synthetic polynucleotide sequence
cacaagctacagcatcagcga

SEQ ID NO: 53557 - DNA, 18 bp, Artificial sequence
  synthetic polynucleotide sequence
agcagctggcgcaggcca

SEQ ID NO: 53558 - DNA, 20 bp, Artificial sequence
  synthetic polynucleotide sequence
tgcaggctgcagagcgcgca

SEQ ID NO: 53559 - DNA, 25 bp, Artificial sequence
  synthetic polynucleotide sequence
acagactagcaagatgggcactaca

SEQ ID NO: 53560 - DNA, 23 bp, Artificial sequence
  synthetic polynucleotide sequence
caaaaaaggtgacacgaggcaca

SEQ ID NO: 53561 - DNA, 18 bp, Artificial sequence
  synthetic polynucleotide sequence
ccagggtgccctgctcca

SEQ ID NO: 53562 - DNA, 18 bp, Artificial sequence
  synthetic polynucleotide sequence
tgtcccgcaggacccgga

SEQ ID NO: 53563 - DNA, 21 bp, Artificial sequence
  synthetic polynucleotide sequence
tgctacccatccccttcccca

SEQ ID NO: 53564 - DNA, 20 bp, Artificial sequence
  synthetic polynucleotide sequence
cggtcccaggcacacacgta

SEQ ID NO: 53565 - DNA, 22 bp, Artificial sequence
  synthetic polynucleotide sequence
accagaccgcagagttcaagga

SEQ ID NO: 53566 - DNA, 21 bp, Artificial sequence
  synthetic polynucleotide sequence
ggttccccaggaccttgagca

SEQ ID NO: 53567 - DNA, 21 bp, Artificial sequence
  synthetic polynucleotide sequence
cccgagggagaaacaaaggca

SEQ ID NO: 53568 - DNA, 19 bp, Artificial sequence
  synthetic polynucleotide sequence
gcgctgggctggcgtggca

SEQ ID NO: 53569 - DNA, 21 bp, Artificial sequence
  synthetic polynucleotide sequence
cacccacaactaccctagcca

SEQ ID NO: 53570 - DNA, 22 bp, Artificial sequence
  synthetic polynucleotide sequence
aaaggtgcaagatgagagccca

SEQ ID NO: 53571 - DNA, 25 bp, Artificial sequence
  synthetic polynucleotide sequence
aaacagcccttactaagccgagaga

SEQ ID NO: 53572 - DNA, 23 bp, Artificial sequence
  synthetic polynucleotide sequence
gaataggaatacagccatgccca

SEQ ID NO: 53573 - DNA, 19 bp, Artificial sequence
  synthetic polynucleotide sequence
cacccctcacggctgcaga

SEQ ID NO: 53574 - DNA, 20 bp, Artificial sequence
  synthetic polynucleotide sequence
gtgtctctgggaaggccaga

SEQ ID NO: 53575 - DNA, 18 bp, Artificial sequence
  synthetic polynucleotide sequence
gatggaagctgcacgcca

SEQ ID NO: 53576 - DNA, 18 bp, Artificial sequence
  synthetic polynucleotide sequence
gccatctgacccatccga

SEQ ID NO: 53577 - DNA, 19 bp, Artificial sequence
  synthetic polynucleotide sequence
cccgaggggagcaaggaca

SEQ ID NO: 53578 - DNA, 23 bp, Artificial sequence
  synthetic polynucleotide sequence
caaaaagctgaaggttcggagca

SEQ ID NO: 53579 - DNA, 20 bp, Artificial sequence
  synthetic polynucleotide sequence
catcgcctacacccgcaaca

SEQ ID NO: 53580 - DNA, 20 bp, Artificial sequence
  synthetic polynucleotide sequence
gagagggtggcagatggcca

SEQ ID NO: 53581 - DNA, 20 bp, Artificial sequence
  synthetic polynucleotide sequence
ccatctgccaccccctccga

SEQ ID NO: 53582 - DNA, 23 bp, Artificial sequence
  synthetic polynucleotide sequence
gataaaaggactccagtggtcca

SEQ ID NO: 53583 - DNA, 17 bp, Artificial sequence
  synthetic polynucleotide sequence
gtcggagccgagccgga

SEQ ID NO: 53584 - DNA, 17 bp, Artificial sequence
  synthetic polynucleotide sequence
gggcggagaaagcgcca

SEQ ID NO: 53585 - DNA, 20 bp, Artificial sequence
  synthetic polynucleotide sequence
ctgcttggacaatggagcca

SEQ ID NO: 53586 - DNA, 22 bp, Artificial sequence
  synthetic polynucleotide sequence
gaacatccttgcccagcagaga

SEQ ID NO: 53587 - DNA, 18 bp, Artificial sequence
  synthetic polynucleotide sequence
cacctggaccacctgcca

SEQ ID NO: 53588 - DNA, 20 bp, Artificial sequence
  synthetic polynucleotide sequence
tggacagaaggttggagcca

SEQ ID NO: 53589 - DNA, 21 bp, Artificial sequence
  synthetic polynucleotide sequence
ttgtggcaagatcgtcggcaa

SEQ ID NO: 53590 - DNA, 18 bp, Artificial sequence
  synthetic polynucleotide sequence
cagcagcatccggcggca

SEQ ID NO: 53591 - DNA, 20 bp, Artificial sequence
  synthetic polynucleotide sequence
gcagagggttaaggcgcaga

SEQ ID NO: 53592 - DNA, 22 bp, Artificial sequence
  synthetic polynucleotide sequence
ttgcaaaacctcaaagcctcca

SEQ ID NO: 53593 - DNA, 20 bp, Artificial sequence
  synthetic polynucleotide sequence
ctgcaccggagaattcagga

SEQ ID NO: 53594 - DNA, 21 bp, Artificial sequence
  synthetic polynucleotide sequence
gccatggaaagcaggcctgga

SEQ ID NO: 53595 - DNA, 22 bp, Artificial sequence
  synthetic polynucleotide sequence
accagctccgaaatcaccacca

SEQ ID NO: 53596 - DNA, 19 bp, Artificial sequence
  synthetic polynucleotide sequence
gtcagcctcctgctcccca

SEQ ID NO: 53597 - DNA, 18 bp, Artificial sequence
  synthetic polynucleotide sequence
caaggcagaaccacccca

SEQ ID NO: 53598 - DNA, 19 bp, Artificial sequence
  synthetic polynucleotide sequence
ccaatggtcacctgccaca

SEQ ID NO: 53599 - DNA, 21 bp, Artificial sequence
  synthetic polynucleotide sequence
cagcaaggaccagttcccaga

SEQ ID NO: 53600 - DNA, 20 bp, Artificial sequence
  synthetic polynucleotide sequence
ctgcccagctgtgtcccaca

SEQ ID NO: 53601 - DNA, 21 bp, Artificial sequence
  synthetic polynucleotide sequence
cattgctcgacagatgcggca

SEQ ID NO: 53602 - DNA, 21 bp, Artificial sequence
  synthetic polynucleotide sequence
atgtcatgaggatggcggcca

SEQ ID NO: 53603 - DNA, 18 bp, Artificial sequence
  synthetic polynucleotide sequence
ccatcgtgcgctgcccca

SEQ ID NO: 53604 - DNA, 18 bp, Artificial sequence
  synthetic polynucleotide sequence
cggtcagctgggtggcca

SEQ ID NO: 53605 - DNA, 21 bp, Artificial sequence
  synthetic polynucleotide sequence
ccacaaaaccaagcgaggcca

SEQ ID NO: 53606 - DNA, 21 bp, Artificial sequence
  synthetic polynucleotide sequence
ttgtaggcttcagacgcacga

SEQ ID NO: 53607 - DNA, 21 bp, Artificial sequence
  synthetic polynucleotide sequence
aacttacggcaagcctgtcca

SEQ ID NO: 53608 - DNA, 21 bp, Artificial sequence
  synthetic polynucleotide sequence
ttcaggactctcagagcccca

SEQ ID NO: 53609 - DNA, 20 bp, Artificial sequence
  synthetic polynucleotide sequence
acacaaggtcggtggcccaa

SEQ ID NO: 53610 - DNA, 22 bp, Artificial sequence
  synthetic polynucleotide sequence
tcatctcaatgtggcagggaga

SEQ ID NO: 53611 - DNA, 18 bp, Artificial sequence
  synthetic polynucleotide sequence
cgggacctgaccaccgca

SEQ ID NO: 53612 - DNA, 18 bp, Artificial sequence
  synthetic polynucleotide sequence
ggcacttgctggccgcga

SEQ ID NO: 53613 - DNA, 18 bp, Artificial sequence
  synthetic polynucleotide sequence
atgcccgaatgccagaga

SEQ ID NO: 53614 - DNA, 18 bp, Artificial sequence
  synthetic polynucleotide sequence
cagcctggtcagccagga

SEQ ID NO: 53615 - DNA, 21 bp, Artificial sequence
  synthetic polynucleotide sequence
ggaaagaggagaggcacccga

SEQ ID NO: 53616 - DNA, 22 bp, Artificial sequence
  synthetic polynucleotide sequence
aatgccaacagcatgctgggta

SEQ ID NO: 53617 - DNA, 21 bp, Artificial sequence
  synthetic polynucleotide sequence
catcgaaaggagcaagagcaa

SEQ ID NO: 53618 - DNA, 20 bp, Artificial sequence
  synthetic polynucleotide sequence
gctgttagcaactacgcgca

SEQ ID NO: 53619 - DNA, 22 bp, Artificial sequence
  synthetic polynucleotide sequence
gaaaggcaaaccagagctcaga

SEQ ID NO: 53620 - DNA, 19 bp, Artificial sequence
  synthetic polynucleotide sequence
ccggggccacaagtctgca

SEQ ID NO: 53621 - DNA, 21 bp, Artificial sequence
  synthetic polynucleotide sequence
tcctgcccctcctaaagctga

SEQ ID NO: 53622 - DNA, 19 bp, Artificial sequence
  synthetic polynucleotide sequence
gggagcgctcttccgagga

SEQ ID NO: 53623 - DNA, 20 bp, Artificial sequence
  synthetic polynucleotide sequence
gtgacttccgaccgaagcaa

SEQ ID NO: 53624 - DNA, 20 bp, Artificial sequence
  synthetic polynucleotide sequence
tcggatgggcatggatcgca

SEQ ID NO: 53625 - DNA, 20 bp, Artificial sequence
  synthetic polynucleotide sequence
ggacgctactccggacgcaa

SEQ ID NO: 53626 - DNA, 21 bp, Artificial sequence
  synthetic polynucleotide sequence
ggtagcggtcaattccagcca

SEQ ID NO: 53627 - DNA, 21 bp, Artificial sequence
  synthetic polynucleotide sequence
cagactgaggaagacccggaa

SEQ ID NO: 53628 - DNA, 21 bp, Artificial sequence
  synthetic polynucleotide sequence
atccggtggtgatgcagacca

SEQ ID NO: 53629 - DNA, 20 bp, Artificial sequence
  synthetic polynucleotide sequence
gcctacattgcccaccccaa

SEQ ID NO: 53630 - DNA, 21 bp, Artificial sequence
  synthetic polynucleotide sequence
ggaactgaagctggggctgca

SEQ ID NO: 53631 - DNA, 20 bp, Artificial sequence
  synthetic polynucleotide sequence
aggctacaaaggggtcacca

SEQ ID NO: 53632 - DNA, 18 bp, Artificial sequence
  synthetic polynucleotide sequence
cagcgcgtgccacagaga

SEQ ID NO: 53633 - DNA, 19 bp, Artificial sequence
  synthetic polynucleotide sequence
gtggccgcaaagaagacga

SEQ ID NO: 53634 - DNA, 20 bp, Artificial sequence
  synthetic polynucleotide sequence
gatttcctcaaagctgggca

SEQ ID NO: 53635 - DNA, 21 bp, Artificial sequence
  synthetic polynucleotide sequence
cacctcgggcactcaaagaga

SEQ ID NO: 53636 - DNA, 19 bp, Artificial sequence
  synthetic polynucleotide sequence
ctggacagccgcacacgga

SEQ ID NO: 53637 - DNA, 21 bp, Artificial sequence
  synthetic polynucleotide sequence
cagaccccttgtgaagcccaa

SEQ ID NO: 53638 - DNA, 20 bp, Artificial sequence
  synthetic polynucleotide sequence
cttccggaagccactgggca

SEQ ID NO: 53639 - DNA, 18 bp, Artificial sequence
  synthetic polynucleotide sequence
ggtgtgtgcccaggcaga

SEQ ID NO: 53640 - DNA, 20 bp, Artificial sequence
  synthetic polynucleotide sequence
tagcacacatggaaccacca

SEQ ID NO: 53641 - DNA, 20 bp, Artificial sequence
  synthetic polynucleotide sequence
tacgcccgagatgaaacaga

SEQ ID NO: 53642 - DNA, 22 bp, Artificial sequence
  synthetic polynucleotide sequence
gaatttggcacgaaccatgcca

SEQ ID NO: 53643 - DNA, 22 bp, Artificial sequence
  synthetic polynucleotide sequence
gaaagcggcgttatgacaggaa

SEQ ID NO: 53644 - DNA, 21 bp, Artificial sequence
  synthetic polynucleotide sequence
tctgcagttgggctcaacgca

SEQ ID NO: 53645 - DNA, 20 bp, Artificial sequence
  synthetic polynucleotide sequence
cagccagcacgccaagtaca

SEQ ID NO: 53646 - DNA, 18 bp, Artificial sequence
  synthetic polynucleotide sequence
tccaggcaccgccagcca

SEQ ID NO: 53647 - DNA, 21 bp, Artificial sequence
  synthetic polynucleotide sequence
agcccgacgaaaggatgccaa

SEQ ID NO: 53648 - DNA, 18 bp, Artificial sequence
  synthetic polynucleotide sequence
ctgccaaaccggggggca

SEQ ID NO: 53649 - DNA, 19 bp, Artificial sequence
  synthetic polynucleotide sequence
aagcgattcctggccaaga

SEQ ID NO: 53650 - DNA, 21 bp, Artificial sequence
  synthetic polynucleotide sequence
gatcgtgaccttcagacagca

SEQ ID NO: 53651 - DNA, 20 bp, Artificial sequence
  synthetic polynucleotide sequence
gaccatgcgccggaacacca

SEQ ID NO: 53652 - DNA, 20 bp, Artificial sequence
  synthetic polynucleotide sequence
ctgcaaccgccgccttctca

SEQ ID NO: 53653 - DNA, 18 bp, Artificial sequence
  synthetic polynucleotide sequence
ggaggccacaggagcaga

SEQ ID NO: 53654 - DNA, 19 bp, Artificial sequence
  synthetic polynucleotide sequence
ccagggcagaggaccaaca

SEQ ID NO: 53655 - DNA, 22 bp, Artificial sequence
  synthetic polynucleotide sequence
agatctatgaaggccaagtgga

SEQ ID NO: 53656 - DNA, 18 bp, Artificial sequence
  synthetic polynucleotide sequence
tggcaaggcctgcatcca

SEQ ID NO: 53657 - DNA, 19 bp, Artificial sequence
  synthetic polynucleotide sequence
gaagcccagacaccaggaa

SEQ ID NO: 53658 - DNA, 19 bp, Artificial sequence
  synthetic polynucleotide sequence
caggtagccctggagctga

SEQ ID NO: 53659 - DNA, 21 bp, Artificial sequence
  synthetic polynucleotide sequence
ctggcccacaagtacagacca

SEQ ID NO: 53660 - DNA, 19 bp, Artificial sequence
  synthetic polynucleotide sequence
ttacgacacagggcaggca

SEQ ID NO: 53661 - DNA, 21 bp, Artificial sequence
  synthetic polynucleotide sequence
ctcccacaaccctgagaccaa

SEQ ID NO: 53662 - DNA, 20 bp, Artificial sequence
  synthetic polynucleotide sequence
gatggtggagggcttgccga

SEQ ID NO: 53663 - DNA, 19 bp, Artificial sequence
  synthetic polynucleotide sequence
gaggaaccctgcggaggga

SEQ ID NO: 53664 - DNA, 22 bp, Artificial sequence
  synthetic polynucleotide sequence
caaatagtccgaacggtagcca

SEQ ID NO: 53665 - DNA, 18 bp, Artificial sequence
  synthetic polynucleotide sequence
tcactgtgccagcccaga

SEQ ID NO: 53666 - DNA, 18 bp, Artificial sequence
  synthetic polynucleotide sequence
tgctggatgaccagccca

SEQ ID NO: 53667 - DNA, 20 bp, Artificial sequence
  synthetic polynucleotide sequence
ggtatcgaggcggacgacga

SEQ ID NO: 53668 - DNA, 20 bp, Artificial sequence
  synthetic polynucleotide sequence
caccagcaggtacactggca

SEQ ID NO: 53669 - DNA, 20 bp, Artificial sequence
  synthetic polynucleotide sequence
cccgaggctacgtgaaggaa

SEQ ID NO: 53670 - DNA, 18 bp, Artificial sequence
  synthetic polynucleotide sequence
caggtcgctcaccctcca

SEQ ID NO: 53671 - DNA, 21 bp, Artificial sequence
  synthetic polynucleotide sequence
accgcttcgagaagcgccaca

SEQ ID NO: 53672 - DNA, 20 bp, Artificial sequence
  synthetic polynucleotide sequence
gtcttgctcagaggccggca

SEQ ID NO: 53673 - DNA, 21 bp, Artificial sequence
  synthetic polynucleotide sequence
aggtggagatcaagcccgaga

SEQ ID NO: 53674 - DNA, 19 bp, Artificial sequence
  synthetic polynucleotide sequence
tgagagggatgaagcggga

SEQ ID NO: 53675 - DNA, 20 bp, Artificial sequence
  synthetic polynucleotide sequence
taggccgtgctccaaagtca

SEQ ID NO: 53676 - DNA, 20 bp, Artificial sequence
  synthetic polynucleotide sequence
atctggggctgatcacccca

SEQ ID NO: 53677 - DNA, 20 bp, Artificial sequence
  synthetic polynucleotide sequence
ggagatgattgagccgcgca

SEQ ID NO: 53678 - DNA, 21 bp, Artificial sequence
  synthetic polynucleotide sequence
gaccaccaccctttacacgga

SEQ ID NO: 53679 - DNA, 21 bp, Artificial sequence
  synthetic polynucleotide sequence
tccccagcaaaaagctccgca

SEQ ID NO: 53680 - DNA, 22 bp, Artificial sequence
  synthetic polynucleotide sequence
atctcctgatccaaggctgaga

SEQ ID NO: 53681 - DNA, 19 bp, Artificial sequence
  synthetic polynucleotide sequence
ggaagctgaaagtccccga

SEQ ID NO: 53682 - DNA, 18 bp, Artificial sequence
  synthetic polynucleotide sequence
ccccagcgccaccccgga

SEQ ID NO: 53683 - DNA, 20 bp, Artificial sequence
  synthetic polynucleotide sequence
acgcctcatccctgcaccca

SEQ ID NO: 53684 - DNA, 21 bp, Artificial sequence
  synthetic polynucleotide sequence
agcagtcatcgataccagcca

SEQ ID NO: 53685 - DNA, 22 bp, Artificial sequence
  synthetic polynucleotide sequence
aaggaccacgcatccatccaga

SEQ ID NO: 53686 - DNA, 22 bp, Artificial sequence
  synthetic polynucleotide sequence
atctgactcacccatcctacga

SEQ ID NO: 53687 - DNA, 21 bp, Artificial sequence
  synthetic polynucleotide sequence
gggcacagccctaaaggccaa

SEQ ID NO: 53688 - DNA, 21 bp, Artificial sequence
  synthetic polynucleotide sequence
gatcagctggacccttacaca

SEQ ID NO: 53689 - DNA, 21 bp, Artificial sequence
  synthetic polynucleotide sequence
agtgaacaaatccgggggcaa

SEQ ID NO: 53690 - DNA, 18 bp, Artificial sequence
  synthetic polynucleotide sequence
ctggccagggagcctcga

SEQ ID NO: 53691 - DNA, 20 bp, Artificial sequence
  synthetic polynucleotide sequence
tctgaagcgagcgtcttcga

SEQ ID NO: 53692 - DNA, 21 bp, Artificial sequence
  synthetic polynucleotide sequence
ttgcgggcttcacgagatcga

SEQ ID NO: 53693 - DNA, 20 bp, Artificial sequence
  synthetic polynucleotide sequence
gtgcagagccccaattccta

SEQ ID NO: 53694 - DNA, 20 bp, Artificial sequence
  synthetic polynucleotide sequence
tcctgtaggctggcagagga

SEQ ID NO: 53695 - DNA, 20 bp, Artificial sequence
  synthetic polynucleotide sequence
caccagccgtgtgcagccta

SEQ ID NO: 53696 - DNA, 20 bp, Artificial sequence
  synthetic polynucleotide sequence
gtccatgaattccacgcgca

SEQ ID NO: 53697 - DNA, 21 bp, Artificial sequence
  synthetic polynucleotide sequence
gtcaccagcagctgtactgga

SEQ ID NO: 53698 - DNA, 21 bp, Artificial sequence
  synthetic polynucleotide sequence
tggcggcacatattgaggcca

SEQ ID NO: 53699 - DNA, 18 bp, Artificial sequence
  synthetic polynucleotide sequence
tgccattgcccaggcaga

SEQ ID NO: 53700 - DNA, 19 bp, Artificial sequence
  synthetic polynucleotide sequence
gatcatcaggccatccaca

SEQ ID NO: 53701 - DNA, 22 bp, Artificial sequence
  synthetic polynucleotide sequence
tcgatggcaaggtccgaactga

SEQ ID NO: 53702 - DNA, 19 bp, Artificial sequence
  synthetic polynucleotide sequence
gtagcggatggtgcgggca

SEQ ID NO: 53703 - DNA, 18 bp, Artificial sequence
  synthetic polynucleotide sequence
cctgcgccgtgtgaacca

SEQ ID NO: 53704 - DNA, 18 bp, Artificial sequence
  synthetic polynucleotide sequence
gagctcatctgccaggca

SEQ ID NO: 53705 - DNA, 20 bp, Artificial sequence
  synthetic polynucleotide sequence
agagctagcagaatccgcaa

SEQ ID NO: 53706 - DNA, 22 bp, Artificial sequence
  synthetic polynucleotide sequence
acgtggagtaacaagacgctga

SEQ ID NO: 53707 - DNA, 21 bp, Artificial sequence
  synthetic polynucleotide sequence
agccaagctgactcctgagga

SEQ ID NO: 53708 - DNA, 20 bp, Artificial sequence
  synthetic polynucleotide sequence
ctggaactgctcctccagga

SEQ ID NO: 53709 - DNA, 19 bp, Artificial sequence
  synthetic polynucleotide sequence
cccatgcaacaacaaggga

SEQ ID NO: 53710 - DNA, 20 bp, Artificial sequence
  synthetic polynucleotide sequence
cagtgaactcaggagcggga

SEQ ID NO: 53711 - DNA, 21 bp, Artificial sequence
  synthetic polynucleotide sequence
caaaggagcttgcaaacacca

SEQ ID NO: 53712 - DNA, 18 bp, Artificial sequence
  synthetic polynucleotide sequence
tgggcagccttcagcgca

SEQ ID NO: 53713 - DNA, 19 bp, Artificial sequence
  synthetic polynucleotide sequence
tcgggcaaagagggtgaca

SEQ ID NO: 53714 - DNA, 22 bp, Artificial sequence
  synthetic polynucleotide sequence
cgatgcaggacaggaagacaca

SEQ ID NO: 53715 - DNA, 19 bp, Artificial sequence
  synthetic polynucleotide sequence
gacaagcacaccctgagca

SEQ ID NO: 53716 - DNA, 18 bp, Artificial sequence
  synthetic polynucleotide sequence
gcccccaggaaggtgaca

SEQ ID NO: 53717 - DNA, 21 bp, Artificial sequence
  synthetic polynucleotide sequence
ccgtctacagggatgacctga

SEQ ID NO: 53718 - DNA, 22 bp, Artificial sequence
  synthetic polynucleotide sequence
accagaatgaggaactcctgga

SEQ ID NO: 53719 - DNA, 18 bp, Artificial sequence
  synthetic polynucleotide sequence
gtcgcagctggaacgcaa

SEQ ID NO: 53720 - DNA, 18 bp, Artificial sequence
  synthetic polynucleotide sequence
gggtgccccagcttcaca

SEQ ID NO: 53721 - DNA, 18 bp, Artificial sequence
  synthetic polynucleotide sequence
cttgtgcgcaaacaccca

SEQ ID NO: 53722 - DNA, 18 bp, Artificial sequence
  synthetic polynucleotide sequence
gggcagcactgttcacca

SEQ ID NO: 53723 - DNA, 19 bp, Artificial sequence
  synthetic polynucleotide sequence
gggaagcgtgttgcaagaa

SEQ ID NO: 53724 - DNA, 18 bp, Artificial sequence
  synthetic polynucleotide sequence
tagatggtctgcagcgca

SEQ ID NO: 53725 - DNA, 19 bp, Artificial sequence
  synthetic polynucleotide sequence
gtgcctggagccagtccca

SEQ ID NO: 53726 - DNA, 19 bp, Artificial sequence
  synthetic polynucleotide sequence
gggacccgctgcagactca

SEQ ID NO: 53727 - DNA, 22 bp, Artificial sequence
  synthetic polynucleotide sequence
gaaaaatcggggccatgtccaa

SEQ ID NO: 53728 - DNA, 20 bp, Artificial sequence
  synthetic polynucleotide sequence
cccaaagccaggactgtgca

SEQ ID NO: 53729 - DNA, 21 bp, Artificial sequence
  synthetic polynucleotide sequence
aggaacatcgtgggctgcaga

SEQ ID NO: 53730 - DNA, 20 bp, Artificial sequence
  synthetic polynucleotide sequence
ctggcatgatgcggaggtca

SEQ ID NO: 53731 - DNA, 18 bp, Artificial sequence
  synthetic polynucleotide sequence
ccacgccagcttcggaga

SEQ ID NO: 53732 - DNA, 18 bp, Artificial sequence
  synthetic polynucleotide sequence
cggcgtttcgggcacgaa

SEQ ID NO: 53733 - DNA, 20 bp, Artificial sequence
  synthetic polynucleotide sequence
ctacgaggtggggtcctgga

SEQ ID NO: 53734 - DNA, 21 bp, Artificial sequence
  synthetic polynucleotide sequence
gcaggaaggggatgatgggca

SEQ ID NO: 53735 - DNA, 18 bp, Artificial sequence
  synthetic polynucleotide sequence
ggcacgagcagctgcaga

SEQ ID NO: 53736 - DNA, 21 bp, Artificial sequence
  synthetic polynucleotide sequence
tccacgagcagaatacagcca

SEQ ID NO: 53737 - DNA, 18 bp, Artificial sequence
  synthetic polynucleotide sequence
ggagaagcaagcaggcga

SEQ ID NO: 53738 - DNA, 18 bp, Artificial sequence
  synthetic polynucleotide sequence
ccctgccagccagataga

SEQ ID NO: 53739 - DNA, 22 bp, Artificial sequence
  synthetic polynucleotide sequence
gaagcacagttcccagtacaga

SEQ ID NO: 53740 - DNA, 20 bp, Artificial sequence
  synthetic polynucleotide sequence
cagacatggctgcggaggaa

SEQ ID NO: 53741 - DNA, 25 bp, Artificial sequence
  synthetic polynucleotide sequence
aatagcatgtgacacaggacagcca

SEQ ID NO: 53742 - DNA, 25 bp, Artificial sequence
  synthetic polynucleotide sequence
agggcagaagcatgaaaggacacca

SEQ ID NO: 53743 - DNA, 22 bp, Artificial sequence
  synthetic polynucleotide sequence
tcatgaaccatcacctgcagga

SEQ ID NO: 53744 - DNA, 22 bp, Artificial sequence
  synthetic polynucleotide sequence
tagagcaaccatgccatctgga

SEQ ID NO: 53745 - DNA, 20 bp, Artificial sequence
  synthetic polynucleotide sequence
tacgttggggaggggatgga

SEQ ID NO: 53746 - DNA, 21 bp, Artificial sequence
  synthetic polynucleotide sequence
aatccttctcaagggcagcca

SEQ ID NO: 53747 - DNA, 20 bp, Artificial sequence
  synthetic polynucleotide sequence
gagacgggcgctggcaagca

SEQ ID NO: 53748 - DNA, 20 bp, Artificial sequence
  synthetic polynucleotide sequence
accggtgcactggtcagcca

SEQ ID NO: 53749 - DNA, 18 bp, Artificial sequence
  synthetic polynucleotide sequence
gctctcacagtgccggaa

SEQ ID NO: 53750 - DNA, 18 bp, Artificial sequence
  synthetic polynucleotide sequence
tggacatccgaccacgga

SEQ ID NO: 53751 - DNA, 18 bp, Artificial sequence
  synthetic polynucleotide sequence
gcatggccagccgaacca

SEQ ID NO: 53752 - DNA, 20 bp, Artificial sequence
  synthetic polynucleotide sequence
tagggctgtcttgagagcca

SEQ ID NO: 53753 - DNA, 20 bp, Artificial sequence
  synthetic polynucleotide sequence
ggtatcccacctgaccagca

SEQ ID NO: 53754 - DNA, 20 bp, Artificial sequence
  synthetic polynucleotide sequence
agtctgagagagtgcggcca

SEQ ID NO: 53755 - DNA, 20 bp, Artificial sequence
  synthetic polynucleotide sequence
catccctcccgaccagcaga

SEQ ID NO: 53756 - DNA, 22 bp, Artificial sequence
  synthetic polynucleotide sequence
gtagtcagaaagagtgcggcca

SEQ ID NO: 53757 - DNA, 20 bp, Artificial sequence
  synthetic polynucleotide sequence
catccctcctgaccagcaga

SEQ ID NO: 53758 - DNA, 20 bp, Artificial sequence
  synthetic polynucleotide sequence
gagacggagcaccaggtgca

SEQ ID NO: 53759 - DNA, 22 bp, Artificial sequence
  synthetic polynucleotide sequence
gaatacccaatggcagccccta

SEQ ID NO: 53760 - DNA, 22 bp, Artificial sequence
  synthetic polynucleotide sequence
aacaaggcctggatcgatagca

SEQ ID NO: 53761 - DNA, 18 bp, Artificial sequence
  synthetic polynucleotide sequence
caatgacgccctgcgcca

SEQ ID NO: 53762 - DNA, 18 bp, Artificial sequence
  synthetic polynucleotide sequence
cacgaaggtgacgagcca

SEQ ID NO: 53763 - DNA, 18 bp, Artificial sequence
  synthetic polynucleotide sequence
aggggccctcctcgccaa

SEQ ID NO: 53764 - DNA, 21 bp, Artificial sequence
  synthetic polynucleotide sequence
ttgaagttgcggcggtaccga

SEQ ID NO: 53765 - DNA, 23 bp, Artificial sequence
  synthetic polynucleotide sequence
aaaaaacagcagatggctcgaga

SEQ ID NO: 53766 - DNA, 20 bp, Artificial sequence
  synthetic polynucleotide sequence
tcttgtcatcaccagcggca

SEQ ID NO: 53767 - DNA, 20 bp, Artificial sequence
  synthetic polynucleotide sequence
atgaatgcagggagtgtgga

SEQ ID NO: 53768 - DNA, 22 bp, Artificial sequence
  synthetic polynucleotide sequence
ggtaagttctgagccacgacga

SEQ ID NO: 53769 - DNA, 21 bp, Artificial sequence
  synthetic polynucleotide sequence
ttgcacacctccaggagaaga

SEQ ID NO: 53770 - DNA, 21 bp, Artificial sequence
  synthetic polynucleotide sequence
aagtcaccaacaagtggggca

SEQ ID NO: 53771 - DNA, 18 bp, Artificial sequence
  synthetic polynucleotide sequence
gggttctgcccgcacgga

SEQ ID NO: 53772 - DNA, 19 bp, Artificial sequence
  synthetic polynucleotide sequence
tcgaagagatactcgccca

SEQ ID NO: 53773 - DNA, 21 bp, Artificial sequence
  synthetic polynucleotide sequence
ctatgaccaggccctacagca

SEQ ID NO: 53774 - DNA, 21 bp, Artificial sequence
  synthetic polynucleotide sequence
agtcagtgtgctggagccaca

SEQ ID NO: 53775 - DNA, 20 bp, Artificial sequence
  synthetic polynucleotide sequence
cagggcctcgaggtaacaga

SEQ ID NO: 53776 - DNA, 21 bp, Artificial sequence
  synthetic polynucleotide sequence
acaccaccacagcaaggacca

SEQ ID NO: 53777 - DNA, 18 bp, Artificial sequence
  synthetic polynucleotide sequence
ccccgattaccagcagca

SEQ ID NO: 53778 - DNA, 18 bp, Artificial sequence
  synthetic polynucleotide sequence
gacaggcagcgaaggcca

SEQ ID NO: 53779 - DNA, 21 bp, Artificial sequence
  synthetic polynucleotide sequence
tggctagaggatgaaacgaga

SEQ ID NO: 53780 - DNA, 18 bp, Artificial sequence
  synthetic polynucleotide sequence
caggcatgcagggcgaca

SEQ ID NO: 53781 - DNA, 19 bp, Artificial sequence
  synthetic polynucleotide sequence
ttagagctgcggaacagga

SEQ ID NO: 53782 - DNA, 20 bp, Artificial sequence
  synthetic polynucleotide sequence
tgccaatacttctaggccca

SEQ ID NO: 53783 - DNA, 18 bp, Artificial sequence
  synthetic polynucleotide sequence
cgggcgcctgctactgca

SEQ ID NO: 53784 - DNA, 22 bp, Artificial sequence
  synthetic polynucleotide sequence
gacttcgaagagcgtatcccga

SEQ ID NO: 53785 - DNA, 22 bp, Artificial sequence
  synthetic polynucleotide sequence
gagcccaccagcttaatggaca

SEQ ID NO: 53786 - DNA, 20 bp, Artificial sequence
  synthetic polynucleotide sequence
ccttccttccagcaggggca

SEQ ID NO: 53787 - DNA, 20 bp, Artificial sequence
  synthetic polynucleotide sequence
tccgacctggagctgagaca

SEQ ID NO: 53788 - DNA, 20 bp, Artificial sequence
  synthetic polynucleotide sequence
gcctcagccgtgcccacgaa

SEQ ID NO: 53789 - DNA, 17 bp, Artificial sequence
  synthetic polynucleotide sequence
gcccgtgccccagggaa

SEQ ID NO: 53790 - DNA, 21 bp, Artificial sequence
  synthetic polynucleotide sequence
gtttgggtttacacagcacca

SEQ ID NO: 53791 - DNA, 18 bp, Artificial sequence
  synthetic polynucleotide sequence
ttcctgcagccggggcga

SEQ ID NO: 53792 - DNA, 18 bp, Artificial sequence
  synthetic polynucleotide sequence
tgcgcttgcgctcccgca

SEQ ID NO: 53793 - DNA, 20 bp, Artificial sequence
  synthetic polynucleotide sequence
gtcccggaagtcctcatcga

SEQ ID NO: 53794 - DNA, 20 bp, Artificial sequence
  synthetic polynucleotide sequence
tgggagccccacttgaagca

SEQ ID NO: 53795 - DNA, 22 bp, Artificial sequence
  synthetic polynucleotide sequence
gactgcatcaagtccaaggcaa

SEQ ID NO: 53796 - DNA, 22 bp, Artificial sequence
  synthetic polynucleotide sequence
caagcgtctgtaccagaaggga

SEQ ID NO: 53797 - DNA, 19 bp, Artificial sequence
  synthetic polynucleotide sequence
cgagccgtggtcaggtaga

SEQ ID NO: 53798 - DNA, 22 bp, Artificial sequence
  synthetic polynucleotide sequence
agtgaagcagaagtgaaaccca

SEQ ID NO: 53799 - DNA, 20 bp, Artificial sequence
  synthetic polynucleotide sequence
acccccaagcacacctgcaa

SEQ ID NO: 53800 - DNA, 18 bp, Artificial sequence
  synthetic polynucleotide sequence
gctcccacagtgggccca

SEQ ID NO: 53801 - DNA, 21 bp, Artificial sequence
  synthetic polynucleotide sequence
tcctgggggcttcatcagaga

SEQ ID NO: 53802 - DNA, 21 bp, Artificial sequence
  synthetic polynucleotide sequence
ccatctccacaaccactggca

SEQ ID NO: 53803 - DNA, 18 bp, Artificial sequence
  synthetic polynucleotide sequence
gtccctgtgccagcgcca

SEQ ID NO: 53804 - DNA, 18 bp, Artificial sequence
  synthetic polynucleotide sequence
ccggagccattgtccaca

SEQ ID NO: 53805 - DNA, 21 bp, Artificial sequence
  synthetic polynucleotide sequence
caaaccacctaagctgccgaa

SEQ ID NO: 53806 - DNA, 19 bp, Artificial sequence
  synthetic polynucleotide sequence
tggggcaatatgagaagca

SEQ ID NO: 53807 - DNA, 20 bp, Artificial sequence
  synthetic polynucleotide sequence
gtccgagctcggagcagcga

SEQ ID NO: 53808 - DNA, 20 bp, Artificial sequence
  synthetic polynucleotide sequence
cgtctgccccagtatcggga

SEQ ID NO: 53809 - DNA, 17 bp, Artificial sequence
  synthetic polynucleotide sequence
cagtgggtgcaggcaca

SEQ ID NO: 53810 - DNA, 20 bp, Artificial sequence
  synthetic polynucleotide sequence
gcaaacccatctttgaggca

SEQ ID NO: 53811 - DNA, 18 bp, Artificial sequence
  synthetic polynucleotide sequence
tgacccgggaggcagcca

SEQ ID NO: 53812 - DNA, 20 bp, Artificial sequence
  synthetic polynucleotide sequence
cacccagtagattcccccga

SEQ ID NO: 53813 - DNA, 21 bp, Artificial sequence
  synthetic polynucleotide sequence
caaaatccaggagggaaccga

SEQ ID NO: 53814 - DNA, 20 bp, Artificial sequence
  synthetic polynucleotide sequence
gcaaacgcttaagaattgca

SEQ ID NO: 53815 - DNA, 21 bp, Artificial sequence
  synthetic polynucleotide sequence
gagaaggtggagagggacgaa

SEQ ID NO: 53816 - DNA, 19 bp, Artificial sequence
  synthetic polynucleotide sequence
tctcacgcacgtggaagga

SEQ ID NO: 53817 - DNA, 19 bp, Artificial sequence
  synthetic polynucleotide sequence
cagaggtcactgagcggca

SEQ ID NO: 53818 - DNA, 22 bp, Artificial sequence
  synthetic polynucleotide sequence
ctggaataggagaaggccttga

SEQ ID NO: 53819 - DNA, 21 bp, Artificial sequence
  synthetic polynucleotide sequence
gatatgcacctgcaacggaga

SEQ ID NO: 53820 - DNA, 21 bp, Artificial sequence
  synthetic polynucleotide sequence
gtagttgcaaccaaggaccga

SEQ ID NO: 53821 - DNA, 20 bp, Artificial sequence
  synthetic polynucleotide sequence
gatgacccccgcttccagga

SEQ ID NO: 53822 - DNA, 18 bp, Artificial sequence
  synthetic polynucleotide sequence
cccgggagacgggatgga

SEQ ID NO: 53823 - DNA, 21 bp, Artificial sequence
  synthetic polynucleotide sequence
caaacaggaggaacaaaggga

SEQ ID NO: 53824 - DNA, 18 bp, Artificial sequence
  synthetic polynucleotide sequence
cgtcctgtgaatgggcaa

SEQ ID NO: 53825 - DNA, 21 bp, Artificial sequence
  synthetic polynucleotide sequence
ggggctctgcaagaagggtga

SEQ ID NO: 53826 - DNA, 20 bp, Artificial sequence
  synthetic polynucleotide sequence
attctggggacatggcggta

SEQ ID NO: 53827 - DNA, 20 bp, Artificial sequence
  synthetic polynucleotide sequence
ggatcacgccacgtgctcca

SEQ ID NO: 53828 - DNA, 20 bp, Artificial sequence
  synthetic polynucleotide sequence
ccaccggagtccccattgca

SEQ ID NO: 53829 - DNA, 20 bp, Artificial sequence
  synthetic polynucleotide sequence
gaagccctggccggcatgga

SEQ ID NO: 53830 - DNA, 20 bp, Artificial sequence
  synthetic polynucleotide sequence
cagctggtagaagggcggca

SEQ ID NO: 53831 - DNA, 19 bp, Artificial sequence
  synthetic polynucleotide sequence
cctaccacgcgtcctccga

SEQ ID NO: 53832 - DNA, 21 bp, Artificial sequence
  synthetic polynucleotide sequence
aagtccgaaggtttcccggga

SEQ ID NO: 53833 - DNA, 18 bp, Artificial sequence
  synthetic polynucleotide sequence
tcagggtgccaggcagga

SEQ ID NO: 53834 - DNA, 18 bp, Artificial sequence
  synthetic polynucleotide sequence
tccccgaccaagcttgca

SEQ ID NO: 53835 - DNA, 20 bp, Artificial sequence
  synthetic polynucleotide sequence
caactgccatcagggtgcca

SEQ ID NO: 53836 - DNA, 22 bp, Artificial sequence
  synthetic polynucleotide sequence
cttgcacgactcacagacagca

SEQ ID NO: 53837 - DNA, 18 bp, Artificial sequence
  synthetic polynucleotide sequence
ttccaagccaggacagca

SEQ ID NO: 53838 - DNA, 19 bp, Artificial sequence
  synthetic polynucleotide sequence
cccactgatatcgcagcca

SEQ ID NO: 53839 - DNA, 20 bp, Artificial sequence
  synthetic polynucleotide sequence
tttccaagccaggacagcaa

SEQ ID NO: 53840 - DNA, 21 bp, Artificial sequence
  synthetic polynucleotide sequence
aattcagctctacagccccca

SEQ ID NO: 53841 - DNA, 19 bp, Artificial sequence
  synthetic polynucleotide sequence
cacagttcctccagccaga

SEQ ID NO: 53842 - DNA, 21 bp, Artificial sequence
  synthetic polynucleotide sequence
gcagatgctgaagtcagcaca

SEQ ID NO: 53843 - DNA, 21 bp, Artificial sequence
  synthetic polynucleotide sequence
accaggtagaagtggacccaa

SEQ ID NO: 53844 - DNA, 18 bp, Artificial sequence
  synthetic polynucleotide sequence
gccggcaagtaccttgca

SEQ ID NO: 53845 - DNA, 19 bp, Artificial sequence
  synthetic polynucleotide sequence
ttgggtacaagccctccaa

SEQ ID NO: 53846 - DNA, 21 bp, Artificial sequence
  synthetic polynucleotide sequence
aatttgggagccacctgccta

SEQ ID NO: 53847 - DNA, 18 bp, Artificial sequence
  synthetic polynucleotide sequence
gccttcgcagcctcacca

SEQ ID NO: 53848 - DNA, 18 bp, Artificial sequence
  synthetic polynucleotide sequence
tcggagtggagcagctga

SEQ ID NO: 53849 - DNA, 19 bp, Artificial sequence
  synthetic polynucleotide sequence
gctgcagccctcgcacaca

SEQ ID NO: 53850 - DNA, 20 bp, Artificial sequence
  synthetic polynucleotide sequence
cttcgccatggcctcctgga

SEQ ID NO: 53851 - DNA, 20 bp, Artificial sequence
  synthetic polynucleotide sequence
cactcgcacgtgccgctgca

SEQ ID NO: 53852 - DNA, 20 bp, Artificial sequence
  synthetic polynucleotide sequence
ggccggatggaagtagcgaa

SEQ ID NO: 53853 - DNA, 20 bp, Artificial sequence
  synthetic polynucleotide sequence
ctgggcgtggtgatgggcaa

SEQ ID NO: 53854 - DNA, 20 bp, Artificial sequence
  synthetic polynucleotide sequence
cttcgccagagtccagggca

SEQ ID NO: 53855 - DNA, 21 bp, Artificial sequence
  synthetic polynucleotide sequence
cctcaaccagagcttcgtgga

SEQ ID NO: 53856 - DNA, 21 bp, Artificial sequence
  synthetic polynucleotide sequence
ggcaccaatgctgaggctcca

SEQ ID NO: 53857 - DNA, 20 bp, Artificial sequence
  synthetic polynucleotide sequence
ggcaggaagcgcagcaggaa

SEQ ID NO: 53858 - DNA, 21 bp, Artificial sequence
  synthetic polynucleotide sequence
gtcctgggaagttagaggcga

SEQ ID NO: 53859 - DNA, 20 bp, Artificial sequence
  synthetic polynucleotide sequence
gccatcctcagcggctggaa

SEQ ID NO: 53860 - DNA, 20 bp, Artificial sequence
  synthetic polynucleotide sequence
atcaatcggcagccgcgtca

SEQ ID NO: 53861 - DNA, 20 bp, Artificial sequence
  synthetic polynucleotide sequence
caccggcttccacctgcaga

SEQ ID NO: 53862 - DNA, 21 bp, Artificial sequence
  synthetic polynucleotide sequence
tactgaccagtcccactgcca

SEQ ID NO: 53863 - DNA, 21 bp, Artificial sequence
  synthetic polynucleotide sequence
gtggcctcaacgtgcaacaga

SEQ ID NO: 53864 - DNA, 21 bp, Artificial sequence
  synthetic polynucleotide sequence
ctcggtcaacttccagaggca

SEQ ID NO: 53865 - DNA, 18 bp, Artificial sequence
  synthetic polynucleotide sequence
cgatggacccccatgaga

SEQ ID NO: 53866 - DNA, 20 bp, Artificial sequence
  synthetic polynucleotide sequence
caagtcccatcacagcctca

SEQ ID NO: 53867 - DNA, 18 bp, Artificial sequence
  synthetic polynucleotide sequence
caacgcgcagtgcgagga

SEQ ID NO: 53868 - DNA, 18 bp, Artificial sequence
  synthetic polynucleotide sequence
tgagcctgaaggccacca

SEQ ID NO: 53869 - DNA, 18 bp, Artificial sequence
  synthetic polynucleotide sequence
ccaccagggcctcttcca

SEQ ID NO: 53870 - DNA, 20 bp, Artificial sequence
  synthetic polynucleotide sequence
cagcaggtagccgaagacga

SEQ ID NO: 53871 - DNA, 21 bp, Artificial sequence
  synthetic polynucleotide sequence
gagagcaaccaagagcgagga

SEQ ID NO: 53872 - DNA, 20 bp, Artificial sequence
  synthetic polynucleotide sequence
gtgcttctgcagcagggcca

SEQ ID NO: 53873 - DNA, 20 bp, Artificial sequence
  synthetic polynucleotide sequence
ctaccaggacgagcaggaga

SEQ ID NO: 53874 - DNA, 18 bp, Artificial sequence
  synthetic polynucleotide sequence
gacgctgaagacggcgga

SEQ ID NO: 53875 - DNA, 20 bp, Artificial sequence
  synthetic polynucleotide sequence
gtttcatgaacggggccaca

SEQ ID NO: 53876 - DNA, 18 bp, Artificial sequence
  synthetic polynucleotide sequence
gacggtctcacgggggga

SEQ ID NO: 53877 - DNA, 22 bp, Artificial sequence
  synthetic polynucleotide sequence
aagtttcacctggaacggcaga

SEQ ID NO: 53878 - DNA, 18 bp, Artificial sequence
  synthetic polynucleotide sequence
acacgggcaggggcagca

SEQ ID NO: 53879 - DNA, 21 bp, Artificial sequence
  synthetic polynucleotide sequence
gcaaattggagaaggccgaca

SEQ ID NO: 53880 - DNA, 20 bp, Artificial sequence
  synthetic polynucleotide sequence
aggcagctgcggaagcccga

SEQ ID NO: 53881 - DNA, 21 bp, Artificial sequence
  synthetic polynucleotide sequence
catcacctccagggagatcca

SEQ ID NO: 53882 - DNA, 20 bp, Artificial sequence
  synthetic polynucleotide sequence
ggacacggcgtgcttggcca

SEQ ID NO: 53883 - DNA, 20 bp, Artificial sequence
  synthetic polynucleotide sequence
gtgccatccatgctaagcga

SEQ ID NO: 53884 - DNA, 20 bp, Artificial sequence
  synthetic polynucleotide sequence
tctccccacgaatgcggcga

SEQ ID NO: 53885 - DNA, 20 bp, Artificial sequence
  synthetic polynucleotide sequence
tgcgaggaggagagcatcga

SEQ ID NO: 53886 - DNA, 18 bp, Artificial sequence
  synthetic polynucleotide sequence
ccctgccggtaggtggca

SEQ ID NO: 53887 - DNA, 20 bp, Artificial sequence
  synthetic polynucleotide sequence
tagagccaggagattagcca

SEQ ID NO: 53888 - DNA, 21 bp, Artificial sequence
  synthetic polynucleotide sequence
ggaattgaaccactgaagcca

SEQ ID NO: 53889 - DNA, 18 bp, Artificial sequence
  synthetic polynucleotide sequence
tgccacatgtgcaacgca

SEQ ID NO: 53890 - DNA, 22 bp, Artificial sequence
  synthetic polynucleotide sequence
ggtagatgagagaatggcacca

SEQ ID NO: 53891 - DNA, 20 bp, Artificial sequence
  synthetic polynucleotide sequence
gaagcctgcgtgatacagga

SEQ ID NO: 53892 - DNA, 18 bp, Artificial sequence
  synthetic polynucleotide sequence
gacaacctcccaggcaca

SEQ ID NO: 53893 - DNA, 21 bp, Artificial sequence
  synthetic polynucleotide sequence
ccaggaggcccccaaaaagga

SEQ ID NO: 53894 - DNA, 20 bp, Artificial sequence
  synthetic polynucleotide sequence
acacaggttcccatcggcca

SEQ ID NO: 53895 - DNA, 18 bp, Artificial sequence
  synthetic polynucleotide sequence
tcctgaccggggagcgga

SEQ ID NO: 53896 - DNA, 18 bp, Artificial sequence
  synthetic polynucleotide sequence
catgtcgtggggcagcga

SEQ ID NO: 53897 - DNA, 18 bp, Artificial sequence
  synthetic polynucleotide sequence
ttctgcaacaggcccaca

SEQ ID NO: 53898 - DNA, 18 bp, Artificial sequence
  synthetic polynucleotide sequence
aagcatgctggaagcgga

SEQ ID NO: 53899 - DNA, 18 bp, Artificial sequence
  synthetic polynucleotide sequence
cctgagtgcgtccgccga

SEQ ID NO: 53900 - DNA, 20 bp, Artificial sequence
  synthetic polynucleotide sequence
gaacacctgggcggcgtgca

SEQ ID NO: 53901 - DNA, 21 bp, Artificial sequence
  synthetic polynucleotide sequence
gctgctgtacaaagacgagga

SEQ ID NO: 53902 - DNA, 20 bp, Artificial sequence
  synthetic polynucleotide sequence
cgccacgctctcctgcagca

SEQ ID NO: 53903 - DNA, 20 bp, Artificial sequence
  synthetic polynucleotide sequence
ccacgagatcgacgaggaca

SEQ ID NO: 53904 - DNA, 18 bp, Artificial sequence
  synthetic polynucleotide sequence
tggccgtggcctccacca

SEQ ID NO: 53905 - DNA, 21 bp, Artificial sequence
  synthetic polynucleotide sequence
agccccccaccatccatgtca

SEQ ID NO: 53906 - DNA, 22 bp, Artificial sequence
  synthetic polynucleotide sequence
atgtctcccaaccaaaaccgca

SEQ ID NO: 53907 - DNA, 18 bp, Artificial sequence
  synthetic polynucleotide sequence
ggctacgtccggacccaa

SEQ ID NO: 53908 - DNA, 18 bp, Artificial sequence
  synthetic polynucleotide sequence
gaagagcggcacgagcca

SEQ ID NO: 53909 - DNA, 20 bp, Artificial sequence
  synthetic polynucleotide sequence
cagttctcccggagcgacca

SEQ ID NO: 53910 - DNA, 19 bp, Artificial sequence
  synthetic polynucleotide sequence
ctggtgagtggcgggtcga

SEQ ID NO: 53911 - DNA, 23 bp, Artificial sequence
  synthetic polynucleotide sequence
gaatcgttgtaaatcgaagcaga

SEQ ID NO: 53912 - DNA, 19 bp, Artificial sequence
  synthetic polynucleotide sequence
agccagtcatttgggcaca

SEQ ID NO: 53913 - DNA, 20 bp, Artificial sequence
  synthetic polynucleotide sequence
cacctcctcctgccagccaa

SEQ ID NO: 53914 - DNA, 20 bp, Artificial sequence
  synthetic polynucleotide sequence
cgggaacatgtggggcggca

SEQ ID NO: 53915 - DNA, 20 bp, Artificial sequence
  synthetic polynucleotide sequence
tatgtgcccgtgagctgcca

SEQ ID NO: 53916 - DNA, 18 bp, Artificial sequence
  synthetic polynucleotide sequence
ggctggcagcaccccgaa

SEQ ID NO: 53917 - DNA, 20 bp, Artificial sequence
  synthetic polynucleotide sequence
atggcaactactacggagga

SEQ ID NO: 53918 - DNA, 21 bp, Artificial sequence
  synthetic polynucleotide sequence
atccataccccaccacagcca

SEQ ID NO: 53919 - DNA, 20 bp, Artificial sequence
  synthetic polynucleotide sequence
ggctgtatacacagcaccca

SEQ ID NO: 53920 - DNA, 23 bp, Artificial sequence
  synthetic polynucleotide sequence
gaaggtgattaaagcagaacaga

SEQ ID NO: 53921 - DNA, 21 bp, Artificial sequence
  synthetic polynucleotide sequence
ccccccaaagagctcagcaca

SEQ ID NO: 53922 - DNA, 19 bp, Artificial sequence
  synthetic polynucleotide sequence
ggcatcggtgggacctgca

SEQ ID NO: 53923 - DNA, 22 bp, Artificial sequence
  synthetic polynucleotide sequence
tagagaagatcgtgggctcaga

SEQ ID NO: 53924 - DNA, 20 bp, Artificial sequence
  synthetic polynucleotide sequence
cgaaagttcctgccccgcca

SEQ ID NO: 53925 - DNA, 20 bp, Artificial sequence
  synthetic polynucleotide sequence
ctgagcctcatcgcagccca

SEQ ID NO: 53926 - DNA, 22 bp, Artificial sequence
  synthetic polynucleotide sequence
cgattcaggtcatctgaggcca

SEQ ID NO: 53927 - DNA, 21 bp, Artificial sequence
  synthetic polynucleotide sequence
gaggctgccgagagataccta

SEQ ID NO: 53928 - DNA, 20 bp, Artificial sequence
  synthetic polynucleotide sequence
ctggagtgagaacaccggta

SEQ ID NO: 53929 - DNA, 22 bp, Artificial sequence
  synthetic polynucleotide sequence
caaaggcgtatggactcaggaa

SEQ ID NO: 53930 - DNA, 21 bp, Artificial sequence
  synthetic polynucleotide sequence
cattcccgaaactgcggtcca

SEQ ID NO: 53931 - DNA, 18 bp, Artificial sequence
  synthetic polynucleotide sequence
gtgccaacctcaacggca

SEQ ID NO: 53932 - DNA, 18 bp, Artificial sequence
  synthetic polynucleotide sequence
ccaggttctgccacagca

SEQ ID NO: 53933 - DNA, 21 bp, Artificial sequence
  synthetic polynucleotide sequence
atggagagcccaggaagctca

SEQ ID NO: 53934 - DNA, 22 bp, Artificial sequence
  synthetic polynucleotide sequence
agtataggctcttggaccccaa

SEQ ID NO: 53935 - DNA, 19 bp, Artificial sequence
  synthetic polynucleotide sequence
tcaagaaggacccccgcca

SEQ ID NO: 53936 - DNA, 20 bp, Artificial sequence
  synthetic polynucleotide sequence
aggtctcggggcaaaggtca

SEQ ID NO: 53937 - DNA, 20 bp, Artificial sequence
  synthetic polynucleotide sequence
cagctgctcggaggcagaga

SEQ ID NO: 53938 - DNA, 21 bp, Artificial sequence
  synthetic polynucleotide sequence
ccctgggtttgcagacagcca

SEQ ID NO: 53939 - DNA, 20 bp, Artificial sequence
  synthetic polynucleotide sequence
cctgaagggcaggcgatgga

SEQ ID NO: 53940 - DNA, 18 bp, Artificial sequence
  synthetic polynucleotide sequence
gggctcctcaggcagcca

SEQ ID NO: 53941 - DNA, 19 bp, Artificial sequence
  synthetic polynucleotide sequence
tgtcacaggccctcagcta

SEQ ID NO: 53942 - DNA, 18 bp, Artificial sequence
  synthetic polynucleotide sequence
cacggcctgggggtggta

SEQ ID NO: 53943 - DNA, 20 bp, Artificial sequence
  synthetic polynucleotide sequence
ctagactccagtgcagagga

SEQ ID NO: 53944 - DNA, 22 bp, Artificial sequence
  synthetic polynucleotide sequence
gactgagtatccgtgacaggca

SEQ ID NO: 53945 - DNA, 20 bp, Artificial sequence
  synthetic polynucleotide sequence
ctgcacctcctggacgtcga

SEQ ID NO: 53946 - DNA, 18 bp, Artificial sequence
  synthetic polynucleotide sequence
ccagggggtgctccagga

SEQ ID NO: 53947 - DNA, 18 bp, Artificial sequence
  synthetic polynucleotide sequence
ggcgcccatcctggccaa

SEQ ID NO: 53948 - DNA, 18 bp, Artificial sequence
  synthetic polynucleotide sequence
cagcctggccagcgctca

SEQ ID NO: 53949 - DNA, 19 bp, Artificial sequence
  synthetic polynucleotide sequence
ctgccttccccagccccta

SEQ ID NO: 53950 - DNA, 19 bp, Artificial sequence
  synthetic polynucleotide sequence
ccgcgtagcaggtgccgta

SEQ ID NO: 53951 - DNA, 18 bp, Artificial sequence
  synthetic polynucleotide sequence
cgagcatcgcggcgcaga

SEQ ID NO: 53952 - DNA, 20 bp, Artificial sequence
  synthetic polynucleotide sequence
cccgtagtcgatgagcagca

SEQ ID NO: 53953 - DNA, 20 bp, Artificial sequence
  synthetic polynucleotide sequence
aaccagattggacaggagca

SEQ ID NO: 53954 - DNA, 18 bp, Artificial sequence
  synthetic polynucleotide sequence
ccccgagtcctttgcaca

SEQ ID NO: 53955 - DNA, 20 bp, Artificial sequence
  synthetic polynucleotide sequence
ctccaggactctggcgagaa

SEQ ID NO: 53956 - DNA, 22 bp, Artificial sequence
  synthetic polynucleotide sequence
gtgaggcatcagagctgaacca

SEQ ID NO: 53957 - DNA, 20 bp, Artificial sequence
  synthetic polynucleotide sequence
ctcagcacccagccactcca

SEQ ID NO: 53958 - DNA, 19 bp, Artificial sequence
  synthetic polynucleotide sequence
ccgacggtattgggcccca

SEQ ID NO: 53959 - DNA, 22 bp, Artificial sequence
  synthetic polynucleotide sequence
aggaacaggagcagcagaagga

SEQ ID NO: 53960 - DNA, 19 bp, Artificial sequence
  synthetic polynucleotide sequence
ccaagccgagctgctgcga

SEQ ID NO: 53961 - DNA, 18 bp, Artificial sequence
  synthetic polynucleotide sequence
ccaaggagaaggaccgca

SEQ ID NO: 53962 - DNA, 18 bp, Artificial sequence
  synthetic polynucleotide sequence
atgcacaggtgcagcgca

SEQ ID NO: 53963 - DNA, 19 bp, Artificial sequence
  synthetic polynucleotide sequence
ttcagacctgtgcctccca

SEQ ID NO: 53964 - DNA, 21 bp, Artificial sequence
  synthetic polynucleotide sequence
tagaaaacggccacaacccca

SEQ ID NO: 53965 - DNA, 21 bp, Artificial sequence
  synthetic polynucleotide sequence
tctggggaccacagaaaacca

SEQ ID NO: 53966 - DNA, 20 bp, Artificial sequence
  synthetic polynucleotide sequence
gcagcgtagcggtcatagga

SEQ ID NO: 53967 - DNA, 19 bp, Artificial sequence
  synthetic polynucleotide sequence
tccaaggttgcatgggcca

SEQ ID NO: 53968 - DNA, 22 bp, Artificial sequence
  synthetic polynucleotide sequence
acattgggaccacagaaaggga

SEQ ID NO: 53969 - DNA, 20 bp, Artificial sequence
  synthetic polynucleotide sequence
atcactcccaagatgctcca

SEQ ID NO: 53970 - DNA, 21 bp, Artificial sequence
  synthetic polynucleotide sequence
ggatgcagactgttcgggaca

SEQ ID NO: 53971 - DNA, 21 bp, Artificial sequence
  synthetic polynucleotide sequence
tcagaggacatgcagtgagga

SEQ ID NO: 53972 - DNA, 22 bp, Artificial sequence
  synthetic polynucleotide sequence
aagaatgccaggaagagcggta

SEQ ID NO: 53973 - DNA, 21 bp, Artificial sequence
  synthetic polynucleotide sequence
tgctggattcccacctgcaga

SEQ ID NO: 53974 - DNA, 21 bp, Artificial sequence
  synthetic polynucleotide sequence
gcagaggcttgcagatggcca

SEQ ID NO: 53975 - DNA, 22 bp, Artificial sequence
  synthetic polynucleotide sequence
tgattatgggcctccaactgga

SEQ ID NO: 53976 - DNA, 20 bp, Artificial sequence
  synthetic polynucleotide sequence
cctttgctgggcagagggaa

SEQ ID NO: 53977 - DNA, 20 bp, Artificial sequence
  synthetic polynucleotide sequence
gcgtctctcatctcttggga

SEQ ID NO: 53978 - DNA, 21 bp, Artificial sequence
  synthetic polynucleotide sequence
tgcatgactctgatgacagca

SEQ ID NO: 53979 - DNA, 21 bp, Artificial sequence
  synthetic polynucleotide sequence
tgggctgaccatggcagggaa

SEQ ID NO: 53980 - DNA, 22 bp, Artificial sequence
  synthetic polynucleotide sequence
tcataggccatcaaagccagca

SEQ ID NO: 53981 - DNA, 20 bp, Artificial sequence
  synthetic polynucleotide sequence
cgtgtcagtgcacgcggaga

SEQ ID NO: 53982 - DNA, 20 bp, Artificial sequence
  synthetic polynucleotide sequence
ctggaactgcagcagctcca

SEQ ID NO: 53983 - DNA, 18 bp, Artificial sequence
  synthetic polynucleotide sequence
acgcggacgcgcaggaga

SEQ ID NO: 53984 - DNA, 18 bp, Artificial sequence
  synthetic polynucleotide sequence
gctctccgcgtgcaccga

SEQ ID NO: 53985 - DNA, 19 bp, Artificial sequence
  synthetic polynucleotide sequence
gaacctgcgctgaccgcca

SEQ ID NO: 53986 - DNA, 20 bp, Artificial sequence
  synthetic polynucleotide sequence
tcagtgggcagtgctgagca

SEQ ID NO: 53987 - DNA, 20 bp, Artificial sequence
  synthetic polynucleotide sequence
tctggtggacgtgagcggca

SEQ ID NO: 53988 - DNA, 20 bp, Artificial sequence
  synthetic polynucleotide sequence
tctcggaacctcccgtcaga

SEQ ID NO: 53989 - DNA, 19 bp, Artificial sequence
  synthetic polynucleotide sequence
cggctgtgcaggaggagca

SEQ ID NO: 53990 - DNA, 20 bp, Artificial sequence
  synthetic polynucleotide sequence
tcccggaacctcctgtcaga

SEQ ID NO: 53991 - DNA, 21 bp, Artificial sequence
  synthetic polynucleotide sequence
ttcagctccaagggaaggaga

SEQ ID NO: 53992 - DNA, 19 bp, Artificial sequence
  synthetic polynucleotide sequence
gactccacaggctgcccca

SEQ ID NO: 53993 - DNA, 18 bp, Artificial sequence
  synthetic polynucleotide sequence
gggagcaggcggtagcga

SEQ ID NO: 53994 - DNA, 19 bp, Artificial sequence
  synthetic polynucleotide sequence
cacactccacacccaggaa

SEQ ID NO: 53995 - DNA, 20 bp, Artificial sequence
  synthetic polynucleotide sequence
atccttgtggagcgacccga

SEQ ID NO: 53996 - DNA, 18 bp, Artificial sequence
  synthetic polynucleotide sequence
tctctgctgggccggcca

SEQ ID NO: 53997 - DNA, 21 bp, Artificial sequence
  synthetic polynucleotide sequence
ttgcaccctgaggatcacaga

SEQ ID NO: 53998 - DNA, 21 bp, Artificial sequence
  synthetic polynucleotide sequence
tagtaccaggaggggcttgga

SEQ ID NO: 53999 - DNA, 20 bp, Artificial sequence
  synthetic polynucleotide sequence
tctgccactgaatctggcta

SEQ ID NO: 54000 - DNA, 19 bp, Artificial sequence
  synthetic polynucleotide sequence
cttgccaacaaggtcggta

SEQ ID NO: 54001 - DNA, 20 bp, Artificial sequence
  synthetic polynucleotide sequence
gtcaggctagacccctcgga

SEQ ID NO: 54002 - DNA, 22 bp, Artificial sequence
  synthetic polynucleotide sequence
ctcaaagaggatgcgagctgca

SEQ ID NO: 54003 - DNA, 20 bp, Artificial sequence
  synthetic polynucleotide sequence
gtggccgacaactgcagaca

SEQ ID NO: 54004 - DNA, 20 bp, Artificial sequence
  synthetic polynucleotide sequence
cttgacttgcacatggggca

SEQ ID NO: 54005 - DNA, 20 bp, Artificial sequence
  synthetic polynucleotide sequence
gtcaagctcaaggcaacgaa

SEQ ID NO: 54006 - DNA, 19 bp, Artificial sequence
  synthetic polynucleotide sequence
cttcccaggatagccagga

SEQ ID NO: 54007 - DNA, 22 bp, Artificial sequence
  synthetic polynucleotide sequence
gaattcaggcagcccaagagga

SEQ ID NO: 54008 - DNA, 20 bp, Artificial sequence
  synthetic polynucleotide sequence
cctcagacggtgatgagcca

SEQ ID NO: 54009 - DNA, 18 bp, Artificial sequence
  synthetic polynucleotide sequence
gagcccctgtgggacgga

SEQ ID NO: 54010 - DNA, 20 bp, Artificial sequence
  synthetic polynucleotide sequence
cacagacaggacggtgccga

SEQ ID NO: 54011 - DNA, 18 bp, Artificial sequence
  synthetic polynucleotide sequence
cacccgctgccccaccta

SEQ ID NO: 54012 - DNA, 21 bp, Artificial sequence
  synthetic polynucleotide sequence
gctccaacaggtgcctctgca

SEQ ID NO: 54013 - DNA, 20 bp, Artificial sequence
  synthetic polynucleotide sequence
ccagagctgcaggaggctga

SEQ ID NO: 54014 - DNA, 21 bp, Artificial sequence
  synthetic polynucleotide sequence
tggcacagatcatgtccccca

SEQ ID NO: 54015 - DNA, 18 bp, Artificial sequence
  synthetic polynucleotide sequence
gccgcgcggagaagccaa

SEQ ID NO: 54016 - DNA, 21 bp, Artificial sequence
  synthetic polynucleotide sequence
tcttggagcccagatctgcca

SEQ ID NO: 54017 - DNA, 18 bp, Artificial sequence
  synthetic polynucleotide sequence
cttgcccgcctgcgccga

SEQ ID NO: 54018 - DNA, 18 bp, Artificial sequence
  synthetic polynucleotide sequence
tgccggcgcagtagcgga

SEQ ID NO: 54019 - DNA, 21 bp, Artificial sequence
  synthetic polynucleotide sequence
tctcaactgctctcccgacca

SEQ ID NO: 54020 - DNA, 21 bp, Artificial sequence
  synthetic polynucleotide sequence
tacaactccactccatcggca

SEQ ID NO: 54021 - DNA, 21 bp, Artificial sequence
  synthetic polynucleotide sequence
ggctgaactcgtacatgcaca

SEQ ID NO: 54022 - DNA, 18 bp, Artificial sequence
  synthetic polynucleotide sequence
agtccggagcgcagggca

SEQ ID NO: 54023 - DNA, 20 bp, Artificial sequence
  synthetic polynucleotide sequence
cagtccccaggcactcagca

SEQ ID NO: 54024 - DNA, 20 bp, Artificial sequence
  synthetic polynucleotide sequence
gaggacaggctgagctggga

SEQ ID NO: 54025 - DNA, 21 bp, Artificial sequence
  synthetic polynucleotide sequence
ggaatgggaggctgagcagga

SEQ ID NO: 54026 - DNA, 18 bp, Artificial sequence
  synthetic polynucleotide sequence
ggggcactgatcggggca

SEQ ID NO: 54027 - DNA, 22 bp, Artificial sequence
  synthetic polynucleotide sequence
gcaggccgtgataagtacaaga

SEQ ID NO: 54028 - DNA, 21 bp, Artificial sequence
  synthetic polynucleotide sequence
ggcaagagcgcatctggaaca

SEQ ID NO: 54029 - DNA, 20 bp, Artificial sequence
  synthetic polynucleotide sequence
ctgaggagccattgcgccca

SEQ ID NO: 54030 - DNA, 19 bp, Artificial sequence
  synthetic polynucleotide sequence
ctccccaggacggactgga

SEQ ID NO: 54031 - DNA, 20 bp, Artificial sequence
  synthetic polynucleotide sequence
gcgcggactccggatacgca

SEQ ID NO: 54032 - DNA, 20 bp, Artificial sequence
  synthetic polynucleotide sequence
cattccagggccatcgggca

SEQ ID NO: 54033 - DNA, 19 bp, Artificial sequence
  synthetic polynucleotide sequence
tttccagagcagtcgcgga

SEQ ID NO: 54034 - DNA, 20 bp, Artificial sequence
  synthetic polynucleotide sequence
ctccaggtgctcatgccgca

SEQ ID NO: 54035 - DNA, 19 bp, Artificial sequence
  synthetic polynucleotide sequence
gcctggcagagctctcgga

SEQ ID NO: 54036 - DNA, 20 bp, Artificial sequence
  synthetic polynucleotide sequence
caccacggccaccacagcga

SEQ ID NO: 54037 - DNA, 19 bp, Artificial sequence
  synthetic polynucleotide sequence
cccttctgcaggcagccca

SEQ ID NO: 54038 - DNA, 18 bp, Artificial sequence
  synthetic polynucleotide sequence
caggctcctcacgccgca

SEQ ID NO: 54039 - DNA, 20 bp, Artificial sequence
  synthetic polynucleotide sequence
gccctgccaggaactgcaga

SEQ ID NO: 54040 - DNA, 18 bp, Artificial sequence
  synthetic polynucleotide sequence
gccagcctctgtgcccca

SEQ ID NO: 54041 - DNA, 20 bp, Artificial sequence
  synthetic polynucleotide sequence
ccaaaaggaggcattggaga

SEQ ID NO: 54042 - DNA, 23 bp, Artificial sequence
  synthetic polynucleotide sequence
atccaccctactagcacagagca

SEQ ID NO: 54043 - DNA, 19 bp, Artificial sequence
  synthetic polynucleotide sequence
ggcctcaagtccgtggaga

SEQ ID NO: 54044 - DNA, 19 bp, Artificial sequence
  synthetic polynucleotide sequence
gaggacgaggactcggaca

SEQ ID NO: 54045 - DNA, 20 bp, Artificial sequence
  synthetic polynucleotide sequence
ggactctcgcggccacacga

SEQ ID NO: 54046 - DNA, 20 bp, Artificial sequence
  synthetic polynucleotide sequence
caggtggatgccgtcacgga

SEQ ID NO: 54047 - DNA, 21 bp, Artificial sequence
  synthetic polynucleotide sequence
cccaccatcccaacaagtcaa

SEQ ID NO: 54048 - DNA, 20 bp, Artificial sequence
  synthetic polynucleotide sequence
gctgctgtcggagcaggcaa

SEQ ID NO: 54049 - DNA, 21 bp, Artificial sequence
  synthetic polynucleotide sequence
cagaggagctctatgagggga

SEQ ID NO: 54050 - DNA, 18 bp, Artificial sequence
  synthetic polynucleotide sequence
gcaccagcagcttgacca

SEQ ID NO: 54051 - DNA, 22 bp, Artificial sequence
  synthetic polynucleotide sequence
gcaaaaaacgtgagctcgccca

SEQ ID NO: 54052 - DNA, 18 bp, Artificial sequence
  synthetic polynucleotide sequence
ccgcccggaaccctgtga

SEQ ID NO: 54053 - DNA, 20 bp, Artificial sequence
  synthetic polynucleotide sequence
atcaccaaacgcgaggccga

SEQ ID NO: 54054 - DNA, 19 bp, Artificial sequence
  synthetic polynucleotide sequence
cccaggcgcactcgtgtga

SEQ ID NO: 54055 - DNA, 19 bp, Artificial sequence
  synthetic polynucleotide sequence
tgagtctcaggatgcagga

SEQ ID NO: 54056 - DNA, 21 bp, Artificial sequence
  synthetic polynucleotide sequence
gatttcccaggatactgccca

SEQ ID NO: 54057 - DNA, 19 bp, Artificial sequence
  synthetic polynucleotide sequence
tccaaaaggaggaggacga

SEQ ID NO: 54058 - DNA, 19 bp, Artificial sequence
  synthetic polynucleotide sequence
ccccactgtcctgtgaaga

SEQ ID NO: 54059 - DNA, 19 bp, Artificial sequence
  synthetic polynucleotide sequence
tttgcatgggataggagca

SEQ ID NO: 54060 - DNA, 20 bp, Artificial sequence
  synthetic polynucleotide sequence
ggccaaaggatgcagaagga

SEQ ID NO: 54061 - DNA, 22 bp, Artificial sequence
  synthetic polynucleotide sequence
agctggtacaatggaacggtca

SEQ ID NO: 54062 - DNA, 21 bp, Artificial sequence
  synthetic polynucleotide sequence
tcaacacacagaatgcaggga

SEQ ID NO: 54063 - DNA, 20 bp, Artificial sequence
  synthetic polynucleotide sequence
gagggctggagtgacgccca

SEQ ID NO: 54064 - DNA, 21 bp, Artificial sequence
  synthetic polynucleotide sequence
ggggcatgagtgggatcagca

SEQ ID NO: 54065 - DNA, 19 bp, Artificial sequence
  synthetic polynucleotide sequence
ggcctgtctgcacccagca

SEQ ID NO: 54066 - DNA, 18 bp, Artificial sequence
  synthetic polynucleotide sequence
ggagcctccctgcggcaa

SEQ ID NO: 54067 - DNA, 21 bp, Artificial sequence
  synthetic polynucleotide sequence
ggtcacagacttccaggggaa

SEQ ID NO: 54068 - DNA, 20 bp, Artificial sequence
  synthetic polynucleotide sequence
gattccctggagcctgccga

SEQ ID NO: 54069 - DNA, 21 bp, Artificial sequence
  synthetic polynucleotide sequence
ggtttcaaggtcaccctccca

SEQ ID NO: 54070 - DNA, 21 bp, Artificial sequence
  synthetic polynucleotide sequence
gattctctggaggctgccgaa

SEQ ID NO: 54071 - DNA, 20 bp, Artificial sequence
  synthetic polynucleotide sequence
cgagggcagcgtgaaggaca

SEQ ID NO: 54072 - DNA, 19 bp, Artificial sequence
  synthetic polynucleotide sequence
ttgtccaggaagcttgcca

SEQ ID NO: 54073 - DNA, 20 bp, Artificial sequence
  synthetic polynucleotide sequence
agaggagcttgtggacagga

SEQ ID NO: 54074 - DNA, 20 bp, Artificial sequence
  synthetic polynucleotide sequence
ctttctcatgaagggcgaca

SEQ ID NO: 54075 - DNA, 21 bp, Artificial sequence
  synthetic polynucleotide sequence
ctgcacgggagccaaaagtga

SEQ ID NO: 54076 - DNA, 22 bp, Artificial sequence
  synthetic polynucleotide sequence
agcaccaaaccttccagcctga

SEQ ID NO: 54077 - DNA, 18 bp, Artificial sequence
  synthetic polynucleotide sequence
cctgcaggacgacgccga

SEQ ID NO: 54078 - DNA, 22 bp, Artificial sequence
  synthetic polynucleotide sequence
agaaactgaccagtagcaccga

SEQ ID NO: 54079 - DNA, 19 bp, Artificial sequence
  synthetic polynucleotide sequence
tcctggcagacggagctga

SEQ ID NO: 54080 - DNA, 18 bp, Artificial sequence
  synthetic polynucleotide sequence
agggatggggcctggcga

SEQ ID NO: 54081 - DNA, 19 bp, Artificial sequence
  synthetic polynucleotide sequence
tcggatgcctcagtgcaga

SEQ ID NO: 54082 - DNA, 21 bp, Artificial sequence
  synthetic polynucleotide sequence
tccccaaactgggcgtgggaa

SEQ ID NO: 54083 - DNA, 18 bp, Artificial sequence
  synthetic polynucleotide sequence
aggaacgggaggccgaga

SEQ ID NO: 54084 - DNA, 18 bp, Artificial sequence
  synthetic polynucleotide sequence
tgcacgcacagagggtca

SEQ ID NO: 54085 - DNA, 18 bp, Artificial sequence
  synthetic polynucleotide sequence
tccgcctgggcctctgca

SEQ ID NO: 54086 - DNA, 20 bp, Artificial sequence
  synthetic polynucleotide sequence
acacagggtgcagctctcca

SEQ ID NO: 54087 - DNA, 21 bp, Artificial sequence
  synthetic polynucleotide sequence
agaggtacctgggggaagcta

SEQ ID NO: 54088 - DNA, 20 bp, Artificial sequence
  synthetic polynucleotide sequence
tggtgggtccacacaggcta

SEQ ID NO: 54089 - DNA, 19 bp, Artificial sequence
  synthetic polynucleotide sequence
cagaagcaagcagcagcaa

SEQ ID NO: 54090 - DNA, 18 bp, Artificial sequence
  synthetic polynucleotide sequence
tccagccgtactcgtcca

SEQ ID NO: 54091 - DNA, 21 bp, Artificial sequence
  synthetic polynucleotide sequence
cgcgaggcctagaagcagcaa

SEQ ID NO: 54092 - DNA, 21 bp, Artificial sequence
  synthetic polynucleotide sequence
aagtcaagccctggctgtgga

SEQ ID NO: 54093 - DNA, 21 bp, Artificial sequence
  synthetic polynucleotide sequence
acgtgcacaccctgctcctga

SEQ ID NO: 54094 - DNA, 19 bp, Artificial sequence
  synthetic polynucleotide sequence
ctggggtcatcaggcggca

SEQ ID NO: 54095 - DNA, 20 bp, Artificial sequence
  synthetic polynucleotide sequence
ggcaagatcctggaggcaca

SEQ ID NO: 54096 - DNA, 20 bp, Artificial sequence
  synthetic polynucleotide sequence
gagaggacgccgtcgccgaa

SEQ ID NO: 54097 - DNA, 20 bp, Artificial sequence
  synthetic polynucleotide sequence
ccagatcccactggacgaga

SEQ ID NO: 54098 - DNA, 20 bp, Artificial sequence
  synthetic polynucleotide sequence
ggatgaccagccagttggca

SEQ ID NO: 54099 - DNA, 18 bp, Artificial sequence
  synthetic polynucleotide sequence
caggggcggccttgggaa

SEQ ID NO: 54100 - DNA, 19 bp, Artificial sequence
  synthetic polynucleotide sequence
ctccatggtggctgcccca

SEQ ID NO: 54101 - DNA, 18 bp, Artificial sequence
  synthetic polynucleotide sequence
agaccccatccgcaccaa

SEQ ID NO: 54102 - DNA, 18 bp, Artificial sequence
  synthetic polynucleotide sequence
ctgagggcaatggcgcca

SEQ ID NO: 54103 - DNA, 20 bp, Artificial sequence
  synthetic polynucleotide sequence
gtcaacctggcgctggccga

SEQ ID NO: 54104 - DNA, 20 bp, Artificial sequence
  synthetic polynucleotide sequence
aggccgaagagcacgcggca

SEQ ID NO: 54105 - DNA, 20 bp, Artificial sequence
  synthetic polynucleotide sequence
cccaagggcctggacttgga

SEQ ID NO: 54106 - DNA, 20 bp, Artificial sequence
  synthetic polynucleotide sequence
cggcccaccacgtactggca

SEQ ID NO: 54107 - DNA, 21 bp, Artificial sequence
  synthetic polynucleotide sequence
agactaccaaggtggccgaga

SEQ ID NO: 54108 - DNA, 18 bp, Artificial sequence
  synthetic polynucleotide sequence
ccgcctcaggtgccgtca

SEQ ID NO: 54109 - DNA, 20 bp, Artificial sequence
  synthetic polynucleotide sequence
ccgcgaggtccgcgatgaga

SEQ ID NO: 54110 - DNA, 20 bp, Artificial sequence
  synthetic polynucleotide sequence
ctccacacgcggcaacggca

SEQ ID NO: 54111 - DNA, 20 bp, Artificial sequence
  synthetic polynucleotide sequence
gaggcaaggaagaagagcca

SEQ ID NO: 54112 - DNA, 20 bp, Artificial sequence
  synthetic polynucleotide sequence
tcccagcacagacagtagca

SEQ ID NO: 54113 - DNA, 20 bp, Artificial sequence
  synthetic polynucleotide sequence
gccagggcctggacagtcaa

SEQ ID NO: 54114 - DNA, 21 bp, Artificial sequence
  synthetic polynucleotide sequence
cagtccacaatgtgagcagca

SEQ ID NO: 54115 - DNA, 19 bp, Artificial sequence
  synthetic polynucleotide sequence
gcaatagcagcgccccgga

SEQ ID NO: 54116 - DNA, 20 bp, Artificial sequence
  synthetic polynucleotide sequence
cagtggaagcggcacaggca

SEQ ID NO: 54117 - DNA, 18 bp, Artificial sequence
  synthetic polynucleotide sequence
agcccaagcccaggacca

SEQ ID NO: 54118 - DNA, 20 bp, Artificial sequence
  synthetic polynucleotide sequence
atttaggatcggcaggggaa

SEQ ID NO: 54119 - DNA, 20 bp, Artificial sequence
  synthetic polynucleotide sequence
cttgagcccagtgtgccaga

SEQ ID NO: 54120 - DNA, 20 bp, Artificial sequence
  synthetic polynucleotide sequence
tgactgagacagctcctgga

SEQ ID NO: 54121 - DNA, 20 bp, Artificial sequence
  synthetic polynucleotide sequence
gccttcagccgcagctccaa

SEQ ID NO: 54122 - DNA, 19 bp, Artificial sequence
  synthetic polynucleotide sequence
ggtgctccaggagcgcgaa

SEQ ID NO: 54123 - DNA, 21 bp, Artificial sequence
  synthetic polynucleotide sequence
gaaatgcctggaccctgacca

SEQ ID NO: 54124 - DNA, 19 bp, Artificial sequence
  synthetic polynucleotide sequence
tgctccagacaggtgacca

SEQ ID NO: 54125 - DNA, 20 bp, Artificial sequence
  synthetic polynucleotide sequence
tacctgtctggagcaaggaa

SEQ ID NO: 54126 - DNA, 20 bp, Artificial sequence
  synthetic polynucleotide sequence
ctggccaaaggtcttgggca

SEQ ID NO: 54127 - DNA, 22 bp, Artificial sequence
  synthetic polynucleotide sequence
agaaaccctacagatgcagcga

SEQ ID NO: 54128 - DNA, 19 bp, Artificial sequence
  synthetic polynucleotide sequence
gtgccggaaggccttccca

SEQ ID NO: 54129 - DNA, 18 bp, Artificial sequence
  synthetic polynucleotide sequence
cgggaggcagagggagga

SEQ ID NO: 54130 - DNA, 18 bp, Artificial sequence
  synthetic polynucleotide sequence
tggacccagcaaagccca

SEQ ID NO: 54131 - DNA, 21 bp, Artificial sequence
  synthetic polynucleotide sequence
gggagcattgacatttaggga

SEQ ID NO: 54132 - DNA, 21 bp, Artificial sequence
  synthetic polynucleotide sequence
cagcaatacccaggaagacca

SEQ ID NO: 54133 - DNA, 20 bp, Artificial sequence
  synthetic polynucleotide sequence
gacaggctgaacttccagga

SEQ ID NO: 54134 - DNA, 22 bp, Artificial sequence
  synthetic polynucleotide sequence
taggccaacttctccacacaca

SEQ ID NO: 54135 - DNA, 22 bp, Artificial sequence
  synthetic polynucleotide sequence
tcatctgtctggaggcaaggaa

SEQ ID NO: 54136 - DNA, 18 bp, Artificial sequence
  synthetic polynucleotide sequence
gcaggccctgctctggca

SEQ ID NO: 54137 - DNA, 20 bp, Artificial sequence
  synthetic polynucleotide sequence
aagaccgggaccccctggaa

SEQ ID NO: 54138 - DNA, 21 bp, Artificial sequence
  synthetic polynucleotide sequence
gcattgccattccgccagaga

SEQ ID NO: 54139 - DNA, 21 bp, Artificial sequence
  synthetic polynucleotide sequence
gtggcaatgtctggacaccga

SEQ ID NO: 54140 - DNA, 20 bp, Artificial sequence
  synthetic polynucleotide sequence
ctggccaaaggtcttgggca

SEQ ID NO: 54141 - DNA, 21 bp, Artificial sequence
  synthetic polynucleotide sequence
caaagaagaaccggcccagga

SEQ ID NO: 54142 - DNA, 18 bp, Artificial sequence
  synthetic polynucleotide sequence
ggggacacctgaggggga

SEQ ID NO: 54143 - DNA, 20 bp, Artificial sequence
  synthetic polynucleotide sequence
cacctgtctggagcaaggaa

SEQ ID NO: 54144 - DNA, 20 bp, Artificial sequence
  synthetic polynucleotide sequence
ctggacaaaggtcttgggca

SEQ ID NO: 54145 - DNA, 20 bp, Artificial sequence
  synthetic polynucleotide sequence
tcacagctaagacgccagga

SEQ ID NO: 54146 - DNA, 21 bp, Artificial sequence
  synthetic polynucleotide sequence
cagcaataccaaggaagacca

SEQ ID NO: 54147 - DNA, 20 bp, Artificial sequence
  synthetic polynucleotide sequence
cctggacatggctcagcaga

SEQ ID NO: 54148 - DNA, 21 bp, Artificial sequence
  synthetic polynucleotide sequence
tagagacagcgatacccagga

SEQ ID NO: 54149 - DNA, 21 bp, Artificial sequence
  synthetic polynucleotide sequence
cgtggctagagaagagcgaga

SEQ ID NO: 54150 - DNA, 20 bp, Artificial sequence
  synthetic polynucleotide sequence
cctggcgcagtctagggcca

SEQ ID NO: 54151 - DNA, 23 bp, Artificial sequence
  synthetic polynucleotide sequence
cacctggaagcctagaaatggga

SEQ ID NO: 54152 - DNA, 21 bp, Artificial sequence
  synthetic polynucleotide sequence
ttgccactcctccagagagaa
